United States Patent 9,719,064 (GENOMICS OF ACTINOPLANES UTAHENSIS) - sequence listing, part 6

SEQ ID NO: 16053 - DNA, 9087635 bp, Actinoplanes utahensis (residues 1-1,817,527 of 9,087,635)
ggctgggcggccaccccgccgcgcgcccgcggcgaggtgctccgcaaggctttcgagctgatgaccgagcgggccggtgagctggccaggctgatcagcctggagaacggcaaggcgctggtcgacgcgaagggcgaggtgacgtacgccgccgagttcttccgctggttcgccgaggaggcggtgcggatcgacggcaacctgaccggcgcccccggcggcaccaaccggatcctggtcacccgccagccggtcggcgtgtgcgtgctggtcaccccgtggaacttcccggccgcgatggccacccgcaagatcggcccggcgctcgcggccggctgcaccgtggtgctcaaaccggccagcgacaccccgctgaccgcgctggcgatggccggcatcctggccgaggccggagtgcccgagggggtcgtcaacgtgctgccctcgcgcagctccggcaaggtggtcgcggcgatgctgcgcgacgcccgggtccgcaagctgtcgttcaccgggtccaccgaggtcggccggatcctgctcgcccaggccgccgagaacgtcgtcaacacctcgatggagctgggcggcaacgccccgttcgtggtcttcgccgacgccgacctggacgccgcggtcgacggcgcgatgatcgccaagatgcgcaacggcggcgaggcgtgcaccgcggcgaaccggttcttcgtcgagtccggcgtcgccgaggaattcgcccgcaagctgtcccagcgcatgtcggcgctcgtggtcggcccgggcaccgaggcgaacacccaggtcgggccgctggtcaacgaggacaccgtggccaaggtcgacgccctggtgcgcggtgccctggacgccggcgcgtccgcggtgaccggcggcagccgcccggacgggccgggcttctactacccgccgaccgtgctgaccggcgtcggcccggacgcggcgatcctccgggaggagatcttcggcccggtcgccccgatcgtcacgttcaccggggaggacgaggcggtcaaactggccaacgacaccgagtacggcctggtggcctacgtctacaccggtgacctggcgcgcgggctgcgggtcagcgagcggatcgaggccggcatggtcggcctcaaccgggggctggtcagcgacccggccgcgccgttcggcggggtgaagcagagcggcatcgggcgcgagggcggtcacgagggcctgctggaatacctggagtcgaagtacatcgccgtcaactggtaaccggcgccggtcccgccgcgccgcggcgccgatcccgtagcggaacggctgaccgaaggcgcccggcggcccgcgccgggcgccttcgaagaaagggagccgtcaataccgcgggtgatgtcttgccggtgacacctggcgaagtgaataatcttgcactcaggcctacacccgatggtgccatcgtggcccactggccgatactggtccggttgcccggcaccccccatgcaggtcgggctccaccccggagaggattcctactgccatgcgcaaggcactgatcgcacttgccgccgccggtctgttgacgtcggtcacccttacggcctgtgacggcggctcgaacgacggtgacgccagcggcagcgacgcgggtctccactcgaatgccacctcgtccggcgagggcaggggcggcgtcggcatcgtgctgcccgacacccagagctccacccgctggagcaacgacgacccgaaatacctcaaggccgcgttcaagtcggccaacgtgccgtacgagatccagaacgccgagggcaacgcggacgcgttcaagggcatcgccaaggcgatgctggacagcggcatcaaggtcctgatgatcgcgaacctggactcggtcagcgccaagtgggtgatcgacctggcccactccaagaagatcccggtcatcgactacgaccggctgaccctcaacggcggcgccgactactacgtcagcttcgacaacgagaaggtcggccagttccaggcgaccggcctgatccagtgcctgaaggacaagggcgtcagcaagccggtcatcgccgagctgaacggctcgcccaccgacaacaacgccaccctgttcaaggccgggtacgacgcggtcctgcaggagaagtacgacggcggcgacttcgtgaaggggcccgaccagttcgtcccgcagtgggacaacaacgagggcaaggcgatcttcacgcagatgttgaagcagtggccgacgatcaacggggtgctcgccgccaacgacggcctgggcaacgcggcgatcgaggtgctgaagaagaacggcaagaccggcatcccggtcaccggtcaggacgccaccgtgcagggcctgcagaacatcctcgccggcgaccagtgcatgaccgtgtacaaggccaccaagcaggaggcccagaaggcggccgacctggcgatcgccctggtcaagagcggcaaggcgaccgcccgggacaaggtgaaggacccggagaccggcgcctacgtgccgtccgagctgctcaccccgacgctggtgaccgcccagaacatggtggagacggtgatcaaggaccagttcgtcacttccaaggaactctgcaccgcgaagttcctgcaggcctgccagcagtacggcctggcggccaagccgggcgcgtccagcggcaccggcagctgagtcaccggcaccacgacgccccgctcccggtcacccgggggcggggcgttcccgtcgtcgggccgcccgttaccggcggcccttcagccggcggcccatctccttggcgatctccttcttggcgtcccgctcggccaggacctggcgcttgtcgtacgacttgaggccgcgcgcgatcgccagctcgaccttgacccagccgtccttgaagtagagcgagagcggcaccagggtcagcccgctgccgtcgttcagcgtattcaggatcttgatgatctcggccttgtgcagcaggagtttccgggtgcgccgcggggcgtggttcgtccagctaccgaagccgtactccgcgatgtgcaggttgtacagcatcagctcgccctcgtgctcctgggcgaacgcgtcgaccagcgacgcgcggcccaggcgtaacgtcttcacctcggtgccggccagcaccagaccggcctcgtacgtccggatgatggcgtagtcgtgccgcgccttcttgttcgaggcgatcagcttggtcccgttctccttggccacccgtagaggttaactacgggccgtcgaccgggatcgggcggcgcatcgaatacgtcacgctgctcaaccggtgcggctcgtccttcacgtggatcaccgcgcggttgtacgcctgccagcccgccgcacccgcccggttcagatggcgcaaatcatcgaagcgctcgtcggtgccccagcgcagcaccccgcccgggtgatggaacgtggcggtccagtccatgaaccggtcggtgcccagcgtgccggccgcgcgatactccagccgcgcatactcccaattggtcacccgattgattatgcccgtcccgcggatacctcgccgtccgtactggacaccgcgcgacgtaagccccgggtcgtacaccatccctgaggtttccctgatctgcccccgcggggcttcatcttgatcttcccaagtgcctacgctgcgcccgtctttgcctcggggggagaaagcgatgacgacaggtacggtggcccggctggtctgcggccggcgcagcaaatggatcgtgctggcactgtggatcgtggtgctggtcttcgccggcgggctggccggcaagctcggcggcgtcgaaaagaacgacaacgcctcctggctgcccggctcggccgaggccacccaggtcgccgacctgcagaaacaattccagccggacgacatcgtgccggccatcctggtctacgagcgggccggcggcaccaccccggccgacctgcagaaagcggccgccgacgcccgggcgatcgccacggtccccggagtcaccggccaggtgatcggtccggtcccggcgcccgaccgggcggcgctgcaggtcatcgcgccgatcagggtcgacgccggcggctgggacaagatcaccgaggcggtggaccggatcaagacgatctccggtacgggggacggaggcctcggcgtctacctgaccggaccggcgggggtggcggccgactcggccagcgcgttccagggcatcgacggcaccctgctctacaccacgctgatcgtggtcgcgatcatcctgctcgtcacctatcgcagcccggtgctctggctgctcccgatcatcaccgcgggcgtggcactgaccagcgcccaggcggtgatctacctgctcgccaagcacgccgggctggtggtcaacgggcagagcgccggcatcctgaccgtgctggtcttcggcgccggcaccgactacgccctgctgctggtcgcccgctaccgggaggagctgcgccggcacgaggaccggcacgaggcgatgatgttcgccctgcaccgcgccggcccggcgatcatcgcgagcgccgcgaccgtggcgatcggcatgtcctgcctgatgctcgccgaggtgaacgcgaccagcggcctcggcccggtcgccgcactcggcatcgtggtcggcctgctcgccatgatgaccctgctcccggccctgctggtgatctgcggccggtggctgttctggccggtccgcccccgcttcggcaccccggagccgaccgcgaccgggctgtgggcccggatgggcggccggatcgcccgccgcccccgccaggtgtggctggccaccgcgctcgccctcggcgcgatggcgctcggcctgctgcagctcaacgcgaacgggctcagccagcaggactcgttcaccagcacacagccgtcggtgaccggcctcgaagtgctgagccggcacttcccggccggccagggcgacccggtcgtggtgatcaccgacccggcccaccaggacgcggtgcgcgccgcgttcgccggcaccgccgggatcagccaggtcggcgagccggccgtgaagaacaacctggtcaggttcgagggcacgctgacgtcggcgccggacgggcaggccgccgaggacaccgtccgcgcggtccgcaccgccctggccggcaccggtgccaaggtcggcggcaccaccgccctgaaactcgacatcaaccaggcgaacaagcacgacaaccggctgatcctgccgctggtgctgctcgtcgtgctggccatcctggccatcctgctgcgcgccctgatcgccccgatcctgctgatggccaccgtggtcctgtccttcgccgccgccctcggggtcagcgccctgatcttccggcacgtgttccacttcgccggcgaggacaccgcgttcccgctgttcgtcttcgtcttcctggttgctctcggcatcgactacaacatcttcctgatgacccgggtccgcgaggaggcccgcgatcacggcacccgccgaggcgccctgatcggcctcggcgccaccggcggcgtgatcacctcggccggcatcgtcctggccggtaccttcgccgccctcggcagcctgccgctggtcgccttcgccgaaatcggcttcgcggtcgccttcggcgtcctgctggacaccctgatcgtgcggtccgtgctggtcaccgcattgagcctggatctgggccgctggatgtggtggccgagcgcgctgttccgccatgacccgtcggtggacgccccggtgtcaccggcgccggccatcctcacccaccagaccgactgacttatcggactgccgggcccaccgtgctgcccgggcgcaccgtgctgtcctactcatggtgctgcccgggctcaccgtgctgtctcgctcacggtgctgcccaggctcaccgagccgtccggctcaccgtgctgcctgggctcaccgtgctgccgggcttccttcctcccgcgcttgtttgccgcgcgtctgcctccgcgtgtccgcgcttgtttgccgcgcgtctgcctccgcgtgcccgcgcttgttcgccgcgcgcctgccttggcgcgcccggcgcctttcgcggttcggccgtcgtgctctgcgggccgggccgggcccagccgggcccagccgagccgggccgagccgggccgggccgcgctctggggctgcggtcgggctccggctctgcgggccgggcttcggctgtcgggccgggtgtcagtggtcggtcagggcggcggctcccagatttcgcagagaggcgtcgaggacctgggcggtgtgcgccagcgcgatcctgccgccgcgccggcggaccgcggccgcgacctgcatcaggcagcccgggttcgcggtgaccagcagcgccgcgccggtgtcgaggaccgcggcggccttgcggtcgcccagttcggcggccggctccgggttcagcacgttccagacgccggccgagccgcagcagatctccgggtcggcgatctctcgcagctccagacccggaatgccgcgcagcagggcccgcggctgcgcccggacgccctgcgcgtgcccgagatggcaggcgtcgtgataggccaccgtcagcggcaacggatgtcgcggagcgaccggccccagctcggcgagcagctcggcaagatcccgcaccttggccgcgaacgccgcggcccgagccgcgtacgccggatcctcggccagcaactcgccgtactccttcagcgatgacccgcaccccgcggcgttcaccacgaagaagtccatcccgcaccgctcgaacgtgtcgatcagccgccgggcgaacccctccgcctccgcccgccgcccgttgtgcacgctcagcgccccgcaacagccctgcgcggccgggatcagcacgtcgcagccctcggccgcgaggatccggacggtcgcggagttcacctccgggaagaatgccgactggacacaaccggtcagcatcccgaccaccgcccggcgctgcccgcgcgccgccacccggcgcggcggccgcggcacccggcgaacgcccggcgccagcgattccagcgtggccagggtcggtgcgaagcggtccagcaggccgctacgggtgacgagacgctgaaggcccgatgtccggtacgcccacaacggcccccgcaacagtcgcagccgccgtggataggggaacaccgcgaagatcgccgcgcgcaacgcccgatcccgtgccgggcgcgggtgccgccgctcgacctgggcccgggtgtcctcgatcagccggtcgtagcgaaccccggacgggcacgcggtcacgcaggccatgcagcccagacaactgtcgaagtggccgaccatcgactcgctgagcggctcaccctccaggccctgggcgatcaggtggatccgcccgcgcggcgagtccatctcctcgccccagagcacgtaggtggggcaggtggtcaggcagaagccgcagtgcacacagtcggacacgaggtcggcgcgcggcgggtgcagctcgtcgaaggccccaccgctgctcccggtctcggccgcgcgcagcgcgtcgggcggcaccgccccggtgccgtgggtagcgtccacgtccgccatcagccgcctccctcactcacgccccgccacctccacgaccaccggcccgccgacctagctagctagcctgggacagcgcgccggtcagcttgagcccgacgccgccgggcggccagggcggcacgtcccaccactccggtgcctcggcggacaccttcccgccgagcagggccgcgaccgcggcggcgcgctcccgaaccccggcggcggtgccttcgagcagcacggcgagttcgggttcggcgccgggggcggcgttcacctcgcaggcgctggccgcgaactggccggccaggaccttggcggcgtgcccggggggagcgctcacccgtacgaaagcatgtgaacccggcaccggatgcaaccggaagacgcactcggtgatcagcccgagggtgccgaaggcgccggtgtagagcttgcccaggtcgtaacccgcgacattcttgaccacccggccgccggccctggtgacggtcccgtccggacgcaccgcggtgatcccgatcagcaggtcgcgggcggtgccgtagcgcagccgccgcggcccggaggcgttcgccgcgaccgtgccgccggccgtcgccgcgggcggcgcgtcgagcgccagctgctgcccgggcagccggtgcagatcgcccatcggcgtgccggcgcggaccacggtgatcagatccccggcagcgtgctcgaccaccccggccagccgccgcgtgtcgatgatgaggtccagctcgcggggcggcggaccccagtcgagtttcgtgccgccgccgcggatcaccacgctcaggccgcgggccgcggtgatcagcgcggccgcctccgcggtgtcccggggcgcggcgacgagccgggccggcacccccggagaccaggtcggtgtccccggccggtgcggtcagctcgtccagcgcggccatcagaagatctccgcgacgccggcggtgtgcagcgggtgggcgcccgaccggcggccggggcgttccccgcacagccgcggggtggggaagaccttgcccggattggcgatcccgtccgggtcgaatgcgcaccgcagcagctgcatggtctccaggtcggcgtcgctgaacatgcgcggcatgtaccgtgccttgtccaccccgaccccgtgctccccggtgatcgagccgccgtgctcgatgcacaggtcgaggatcgccccggacaccgtctcggcgcgctcggcctgccccggtatctgcgcgtcgaacagcaccagcggatgcaggttcccgtcgccggcgtggaacacgttcgccacccgcaccccgtgctcggccgcgacctcgccgatgcgccgcagcaccaccggcagcgacatccgcgggatcaccccgtcctgcacgatgtagtcggggctgatccggccgaccgcggcgaacgccgacttgcgcccgcgccagatcagcgcccgctcctggtcgtccgccgcgatcctggtctcgaacgcgccgttgctctcgcagagcgcgctcacctcgtcgaactgcgctgcgacctcggccgccggcccgtccagctcgacgatcagcaccgcgcccgcgccggccggataggagcactgcacggccgcctcggcggccgcgatggccaactcgtccatcatctcgatcgccgcggggagcacgccggccgcgatgatcgccgaggtggcggccccggcctggtcggtggagccgaatccggccagcagggtgcggaccgtctcgggcagccgggtcagccgcacggtgacctcggtcgccaccccgagcgtgccctccgacccgacgaacgcgccgagcaggtcgtagcccggtgtgtcgggcgccgggccgcccagccggacccgctcgccgtccggggtgacgacctccagcccggtgacgtggttggtggtgaagccgtatttcaggcagtgggcgccaccggaattctccgcgacgttgccgccgatcgagcagatctgctggctggacgggtcgggcgcgtagtagtagccgtgtggggcggctgccctggtcacctgcaggttgatcaccccgggctcgaccaccgcccgctcgtcctccggccggacctcgacgatccggcgcagttgggaggtcacgatcagcaccccgtcggcgtgtgggagcgcacccccggacagcccggtgcccgacccgcgggccacgaacggtgtcccggtgtcggcacatgcccggaccaccgcggccacctgcgccgcggtccgcggcagcgccaccagagccgggatgaccttgtagtgcgccagcccgtcgcactcgtaggtccgcagctcctgccggtcggtcaggacccggtcggcgcccagctcagcgcgcagccgagccgccaatgcatcgatgtcggtcatccccaggcctcctcgctgacgcctaccgcaacgctagcggtgatcgacgccgaacgcgacgggcgaccgccggcctgtggaaaaccccggaccgagggtgggcggtggctcacgccgtgtcgaacctgtggacaaccttttcgccgggcggccggagtctgccaagatggcccgatgctcgtgaccgccagaccgttccgggtcgctgtcgccgctgctctcgcgctggtcgcggtggccggctgcagcagttcggacgacgacaagccggactccggccggatcgacgtgaccaccatgcggggcgcgttcctgcaggccgccgagatcggtccgacctggaccgcgccggagaccgacgccagcgccgggacgccgtcgctggtgagcttctgcggcgggaccagcaccccgccggcgctgccgcccggggccgacccggtgtcgtcgtccttcgccgacgagggggagcagggggcgcagacgctggagcagctcgccctggtctacccggacacgacggcggcgcaggccgggcaggcgctgctgcgcgcggtggccgacggctgcccgccgacggcgtccgtgccggcgacggtgacctcggacaagtcggagccggcctacaccgagacggttgaggtgcgcccgctcgacgagggcggctggagcgggtttgtcctggtccggcacaagaagtacgaggcgtcccaccccggtgccgcggacaccgcggtggccgtgctgaccacgcgcaacgtggtgctggtggacacctacgcgatctatcagctggacaagtcggaggccgccgccggcttcgagagcgactggaaaaggctggtcggctcggtcgtccagcgcgtgggatagacagccggacgcggttggtctaatgttcgcggtgcgccgttgcgagttcttcccccgtggaattcgcagcggcgccctttttgtttccggggcttctgccggcccaacggcaatttcatccctcccgttgctcggttctgcgcgaagagagcgcgatctgagcacgcgactccgtaccgctgtggaaaagtccacggaacgttaactattcgccgcaaccgcgcttagccttacgaatcccggggcacgatggcgtgcagccgaggattcttaggcggaggtggctgcggcatgaagttcgtctacgacttccacgagggcaacaaggacctcaaagacctgctgggtggcaagggcgccaatctcgcggagatgacgaacctcggcctcccggtcccgcccggattcaccatcaccaccgaggcgtgtcaggaatacctgcgcgccggtacgcatgtcgacgggctggccggggagatcgacacgcacctggcgacgctggagcaggcgatgggccgccggctcggcgacccggccgatccgctgctggtctcggtccggtccggcgccaagttctcgatgcccgggatgatggagaccgtcctcaacgtcggtctcaacgatgagtcggtggccgggctgtcccggcaggccggtggcaacgaccggttcgcctgggactcgtaccgccgcctgatccagatgttcggcaagacggtgtgcgacgtgcccggggcggagttcgaggacgctctgcaccaggcgaaggtggccaagggtgtcaaggacgacgtgcagctcgacgccgaggatctgcgggcgctggtcacggcgtacaagaaagtgttcgtgaaacacaccgggcacgagttcccgcaggatccgcgcgagcagctcgacctggctgtcgaggcggtcttccggtcgtggaacgccgaccgcgcggtgctctaccggcgacaggagcggatcccggccgacctgggcaccgcggtcaacgtggtggcgatggtcttcggcaacctgggcgacgactccggcaccggcgtcgcgttcacccgcaacccggccagcggcgagcagggcatctacggcgactacctggccaacgcgcagggcgaggacgtggtcgccggaatccgcaacacgctgccgctcgccgagctggagaacctcgacaagcgcagctacgacgaactgttgcggatcatggccatcctcgagggccactaccgcgacctctgcgacatcgagttcaccatcgaacgcggcaaactgtggatgctgcagacccgggtcggcaaacggaccgcggccgccgcgttcaccatcgccgcacaactcgtcgacgagggcgtgatcgacctcgacgaggcgctcacccgcgtcaccggcagccagctcggccagctgatgttcccgcgcttcgacctttccggatcgccggaatcggtcacccgcggcgtcggcgcatccccgggcgcggccgccggcgaggtggttttcacctccgcgcacgcggtcgccgccgccgccgaaggaaaatcagtcattttggtacgtcgtgagacgaacccggacgacctgccgggcatgatcgcggccaagggcatcctcaccagtcggggcggcaaaacctcgcacgccgccgtggtcgcccgcggcatgggcaagacctgtgtctgcggtgccgacgagatcgaggtcggacgcgacaccgtcaccatcggcgcgcacaccatccgcgaaggcgacgtcgtctcgatcgacggcacgaccggccgcgtctacctcggcgaggtgccggtgcgcccgagcgaggtcgtgcagtacttcgagggcgacctggacccgacgcaggccaacgacccgctggtcgccgccgtgcaccggatcatcacgcatgccgatcagaaacggcggttgtccgtgcggaccaacgccgacacgggcaccgacgcggcccgggcccgccggttcggagcccaggggatcggcctgtgccggaccgagcacatgttcctcggcgaccgccgggagctcgtcgaacgcctcatcctcgcccgcaccgacaccgaccggaccgacgcgctggccgccctgcagccgctgcagcgagccgacttcctgcagatcctgcgcgagatgaacgggctgccggtgaccatccggctgatcgacccgccgctgcacgagttcctgccgtccctggaggagctcgcggtcaaggtggcggtcgcgcacgagcagggccagcggctcgaacacgacgaaaagatgctggccgcggtccgcaaaatgcacgagcagaacccgatgctcgggctccgcggcgtacgactgggcctggtcattcccggtcttttcgcgatgcaggtgcgggccatcgcggaagccgcggtggcgctcgcggccgagggcggcaacccgcgcccggagatcatggtgccgctggtcggcgcggtacaggaactggaaacggtccgcgccgaagccgagaagatcatcgccgaggtgatcggcgactccggcgtcacggtgctgatcggcacgatgatcgaggtgccgcgggcggcgctgaccgccgggcagatcgccgaagcggccgaattcttctccttcggtaccaacgacctgacccagatgggctggggcttctcccgcgacgacgtggaaggggcgttcttctggcgctacctggaactcggcatcttcgggatcagccccttcgagtcgatcgacaccgagggcgtggggcggctcgtgcggatcgccgcggaagaggggcgggccgcccggccgggactcaagctcggcgtgtgcggggagcatggcggggacccggattcggtgcacttcttccatgaggtcgggctcgactatgtgtcgtgctcgccgttccgggtgccgatcgcgcggcttgaagccgggcgggcggcggtcgagtccgaaggatccgaccaccggtagaccggcatcaccagctggcggcggtgggcgtgcggcggttcgccgcacgaccgccggccgtccgggcggccccgtgaccactacgcggcggaaacggggccgcccgctttaccctgtcgcggtctcgtccgggtacggctgtcgatccccggcgaaaatgtcggggggtgggtctagcgtccctgaggacagcttccttcggcagaggagtcagcgatggcgtcccggctcaacccgtatctgaccttcgacggcaacgcccgcgaggccatggagacgtatcagcggatcttcggtggcgatctgaaggtcaccacgttcggggagttcggcgtccccgacgagtcgatcaaggacaaggtgatgcacgcgatgctggacacgccgcagggttacaccctgatggcctccgacaccgcgcccggcatgccgttcaccccgggcaacgccaactcggtcagcatcagcggcgacgcctccgacaacctgcgcgccttctgggacaagctcgccgacggcgccaccatcagcctgcccctggagaaacagatgtggggcgacgagttcggccagcttgtcgacagatacggcgtcccctggatggtcaacatcaccgcctgatccgcgccgatcacgtctgccgttcggccttcagcgccgcccggcgtgcccacgttctttcgatgatgctcttgtgcgttgatccggccggggttcgggtccggcgggctcggccggcctgagggtgcgctcagccgggctcagggtgcgctcagtcagccctgtgaatgctgtggctgtgctgacgatcatgatccccgggttgcacatgaccatcgctgacttcgctgtcgtggcggcctcggcggtgctggtgctcgcccgatggctgccgacggccgcacggcgccgcactgctctcagcgccgccgccgtgacgatcgtcggcgcggccttcaccgtgccgggcacccgttggccggtccttctggtgctgggcacggacctgcttgtggtcgcggcaaccgttgcggtgtggctccggaagcgtcgcatcgccctgtccgccagcgatggccgcagtgctgaagtccggcgcgctacgaaggcgcgtagcggcggggctctgcgcgcttcgggcgggggaagcgcggaggtatcggacgcttcggaccggaggagtgcggctcggcgcgccgctgaggcggggagcggggaaagtccgcggggttcgggtggccgaggcggggaggtgtcgggcgcttcgggcggcgggagcggtgcggctctgcaggctgccgatgtggggagccgggaggctttgcgagcctcggacgggcggagtgagggggctgccgggggtggggaggaggatcggcgggttcggcggtcgatggcgttgcccggttcggtggtggccctggggctggtgatcggggccggggcggccgcctgggcgttgccggtgccggtgtttccggcgctgtccggggcgtccgcggtggggacgacagtgctgcagtggacggatccggcgcggggggaggcggccacgccggacgccggcgatcggcgcgcggtggtggtgcagctgtggtatccggcgcagcgggtggcgccggatgcggttcgggcgcagtacctggggcggaatcgtcgcgaagctgaaatcgtcgctgatggggtggctgactatctcggggtgccggggtttctgctcgacgggcctacccgggcacggacccacgcggtggtcggggcgcaaccggcaaccggtcgcttcccggtggtgctgttctcgcccgggctcggcggggtacgcacgcagaacacggcgtgggctgaggaactggccagccgaggctacgtcgtggccggggtggaccacccgtatgactcggccgcggtcgtactcgccgacgggagtaccgtccggacgcgcatcgcggccagcggggaccggaccgaggacaaccgtcggcgaatctcctggacgtcggtgcgggccgcggacctcagcttcgtcctgacccaactcggccgcctggacaagggcgatcctgctggccgtggcgaggagggcgatgctgccggccgtggcgaggactagctagctaggggcgatgctgccggccgtggcgggatgggcgatcctgccggccgtggcgggatgggcgagcctgccggccgtggcgggatgggcgagcctgctggccgcggcgggaaggcagcattcgaccaccgtgcaccggcagacggcggcgagcccggccgtgcgggtggcggtgtcggcggcggtgaggagggcgtcgccggggagttggctggccggctggatgtcggtcgggcggcggtcaccgggcattcgctgggtggggcggcggctgtgcgggctgctcaaggggatccgcggttcaaggcggtcatcgatctggacggtgggctcgacaccgatcagaaggcggtacggcagcccgttctggtggttacccatgagattcgggatcgggcggatgccgactatgtcgcgcgggtgatgacagtgctcgaaggcggcggggcgggcgggtatcggctcaccgtgccggggagtgcgcatctcacgttcaccgatgcgcccctttatctgccgccggtcccgtcgctggtgggttcgctcggggggaacggcagcgtgcggatgacagtggagaccagcgccgcgttcctggacgccaccctgggcgggcggaccgtcgacctgtcggcggcgctggcgaaatacggcgaactgtcagtccggcagcccgcggcggtccggtaaagggcagccgcgggcaggtgggaaggttcgtcagtcgaagaagggctcgtcctcgtcggtgtactcataccgggggaagtcatcctcgaaggaggcggtcggtccggcggaaggaagcgtgccgcgggccggctcggagacgggacgtgcgtcggctgggtgaagcgtgccgcgggccggctcggggacgggacgtgcgtcggctgggtgaagcgtgccgcgggccggctcggggacgggacgcgcgtcggctgcgggaagcgtgccgcgggccggctcagggacgggacgtgcgccggctgcggggagcgtgccgcgggccggctcggagacgggaagtgtgtcaggggccggctcggctgcgtgaagcgcgccacgggcagccgcagtggccgtgccgggaagcccaccgtgggcaggcccggtggtggtgacggggagcgtgccggggacgggcgagtcgccgggcggcggggtgggggacggggtctcgccacggatcacggcgaggacgtcgtcgccgaacttggtgagcttgctctggccgacgccgctgacggtggcgagctggtcgagcgtggcgggggcgaggacggcgatggcgcgcaacgtcttgtcgtggaagatgacgtaaggcgggatggcctgatcgcgggcgatgccggcccgccaggcgcggagcctttcgaagaggggctcggcttcggccgggaagtcggcgggagcgggtgcggccgagcgggagctggacgagcccgaacccgacgatgagcgggcgctggacgcggatcggggacgggccagctcgcggcgcatcatcagggtgacctcgccgcgcaggacggcggcgctgcggtcggtgaggaccagcgtgccgtattcgccctcgaccgccaggtagccgccggccagcagttggcggacgacgccgcgccactcggcctcgcgcaggtcggcgccgatgccgaagaccttgagctggtcgtggcggaactgggcgaccttgtccgtcttcctaccgagcaggatgtcgatcgactggccggcgccgaacttctggttgcgctcgcggtgcaggcgcagcacggtggacagcagtttctgggcggggacggtgccgtcccacgactcgggcggggtgaggcaggtgtcgcagttgccgcacgacgacgatgcggcctcctggtcgaagtaggccaggagctggacgcggcggcaggacaccgtctcgcacagcgcgagcatcgcgtcgaggtgccggttggcgttgcggcggaagttggcgtcgccctccgagccgtcgatcatcttgcggagctggacgacgtcctgcaggccgtaggcgagccaggcggtggacggcaggccgtcgcggccggcgcggccggtctcctggtagtagccctcgacggatttcggcaggtcgagatgggcgacgaagcggacgtccggcttgtcgatgcccatcccgaaggcgatcgtggcgaccatgacgaggccgtcctcgcgcaggaagcgggactggtgctcggcgcgggtgcgggcgtcgagaccggcgtggtagggcagcgcggggacgccgttggcggacaggtattccgcgtgtttctcgacggaggcgcgggacaggcagtagacgatgccggcctcgcccgggtgctcggtgcgcagcaggtcgagcagctggcgcttcggatcatttttcgggacgatccgatactggatgttgggccggtcgaagctggcggtgaagtgccgcgcgtcggtcagctgcagccggcgggcgatctcgtcgcgggtggcggtggtggcggtggcggtcagcgcgatccgcggcacgtcgggccagcgctcgtgcagcatcgacagcgacaggtagtcggggcggaagtcgtggccccactgggagacgcagtgcgcctcgtcgatcgcgaacagcgagatctgcccgcggtcgagcagccgctggacgcccgcggtgcccaggccctcgggcgcgacgtagagcaggtcgagctcgccggcgacgaactcggcctcgaccaggcggcgctcgtcgaggtcctgcgtcgaattcaggaagccggcccggacgccgagcgtgcgcagggcgtcgacctggtcctgcatcagggcgatcagcggggagatcaccacaccggtgccggggcggaccagggcggggatctggtagcacagcgacttgccgccgccggtgggcatcaggaccagggcgtcaccaccgtcgatcacgtgctcgacgatctcgcgctgccggccgcggaaatccggataaccgaagatgcggttgagcgcgtcggtggcactggagacggggatagcgggagccgaagtcaccccgcgatagtagtgagccgcaccgacattctgcccagccctgtggacgacccctatggggttaccggcagcccgaccaggtcgaggatgtgccgcgaggggctgtccggggccgcgatcagggtcagcggggctttgcggtcgtggtgctgctcggcgatcaggtagagcgcggacaccccggcgctggccaggtggtcgaccccggtcaggtcgacggtcatcggcacgttcccgccccggctacggcgcagcagctcctgccgcagcgcgaccgcggaggtgctgtccaccggcccgtcgacccggacccgtgcctcgtcgccgccgggcagctcggtgacggtcatcgcggcgggcggctcggcccggcgcggagcgtcgtcgaaacgggtgagcagccgggccgggcggctcagcgggtgccggacggtggccaccgtgccgtgcgggccgggctcgacgtgcaggctctccaccagctgggcggtgagggccaggccacggccgcggatcggctgccgggagggcgcccgccacccgccgtggtcggtgacgaccgcctcgacccgcccggccgcggtcagcaccgcccggaccgtgacggtccgcccgccgccgtgctcgatcgcgttggtggtcagctcgccgagcgcgtgctggagcacgaacacgtcctgcgcggacgcgccgagctcggccagccaccgccccagccgggcccgcaccccgcgcaactcggtcggcttcgccggaagatcgagggccagctcgggtacgaccggaacccgctgcgccgcgagcagggtgatgtcgtcggcatgcccgccggcccgcaccagcagttcgatggcctgcccgcagacccggtcggccgcggtgctgcccggctcgcgcagcgcccgcccggccgtcgcgtccgcgaccaccttggcgagctccgcgggctgcggcccgccggcctggggccgttccacgatcccgtcggtgtagagcagcagcaggtccccggtcgccagccggtcgtgccggatcgggaagaccccgccggtgccgagcggcgacccgccgctggcggcgaggtagcgggtggtcccgtcgggtccgctgaccagcggcggcgggtgtccggccgtgcagtagtccagcgcaccgccggccgggtcgagcagcaccaggcacacggtggccgcgtgcgccgcctgcatccgcccggcgaaccggtcggcggccgccagcgcctcctcgatcggcgcgccggagtcgaggcgttcccgcagcaccgcccgcagctgccccatggcgccggacgcggtgatgccgtgcccgaccacgtcgccgacgaccagggccacccgcccgtccggccgggccaccgcgtcgaaccagtcgccgccggccgcggtgtccgcgtcggcgagcaggtagctcgcggccacctgcaggccgggcagcaccggcagccctggtggcagcagttcccgctgcagctcggtgatcacgtcccggccctgctcgtagcgctgccgcagccgggcggcctcggcctcggcggcctgccgggtgcgggcgatctcggtgacgtcgaacgcggcgccgatcaccccgcgcagtgtcccgtccgggtcgcgccacggcacgatggtgaaggtcgcgaacatctcgtgcaccgagccgtccggcatgtccaggtgggcccgccactgctggccggcgatcggctcaccggtccggtacacctggtagtacgcgtcgacgaactgctgcccggccaggtcgctgagcacctcccggcagggccggccgatgatgtcccgcccgggcagcaccgccctggtcgccgcgttcgcgccgaccaggagcagctccggtccctcgaaaacggccacgatgaacggcagctgatccaccgcggacagcatcgcccgaagatcgccgcccgccggaatgtccacgcccgtcaccatgccatcgtgccggaaaccgcgccacgcggacccgggggtcactcggccaggggcagttcgatggtgtgcgaggtgtgcgacgccttggcccgcaggtaccggacgttggccgcggagacgtgcaccccggtcgggatccgctgggtcaccgcgacgccgaggccttccagctgcagggccttgtcggggttgttgctgagcagccggatccggtcgacgccgaccgcctgcagcatctgcgccgccgccgtgtagtcgcgttcgtcctcgccgcgccccagcgccaggttcgcctcataggtgtccagcccgtcgtcctgcagcgcgtacgcgtccagcttggcgtacagcccgatgccccgcccctcctgccgcaggtagagcaggaagccgccctgctcggtgatccgctcggcggcctcgcgcagctgcggcccgcagtcgcagcgctggctgccgaacacgtcgccggtcaggcactcgctgtgcgggcggaccagcggcgcccggccgccggccgccgacttggtcagcgcccgccgccagtcgccgaggcccagcgccaggtgctcgcggccgtccgccagcccgtcgaaggtcatcacctgggcggtggtggcgtatccgtcggaaaaccgcagcggcacggtcacctgtcgtcggatgctggccttcaccatcggtcctcctcatttttggcgctgtggcagaggctgtgcccgaagatcggccgccgcacaccgcggattatcgtggacgcacgatggatgagcgtccttacattttgctgagctgcgggatgtcgatcgacggctatctcgacgacacgtccgcggaccgcctgctcctgtcgaacgacgcggatttcgaccgggtcgacgaggtccgcgccggctgtgacgcgatcctggtcggtgcctcgacgatccgccaggacaatccgcgtctgctgatccgctcggcgcagcgccgggcgcggcggctggtccgggggaaaccggcgaatccggtgaaggtgaccgtgaccggtcgcggtgacctcgacccggaggcggcgttcttcaccgcgggcgagtcggcgaaactggtctactgcgccaccggcgcgctggcggcgacccgggaccggctgggcgcggcggccaccgtggtggacggcggcgacccggtcgacgtccgccgggtcagcgccgacctggcccggcgcggcgtgcgccggctgatggtcgagggtggcggcaccatgcacacccagttcctcaccggcgacctcgccgacgagttgcagctggtgatcgcgccgttcttcgtcggggactcccgcgcgccgcggttcgtgcacgacggcgacttcccggccgggccgaagaatcgcgcgcggctcgccgaggtccgccagatcggcgacgtggtgctgctccgctacgcgctctccgaccgcttcagctgagcggatcaaaccccgaccccgctgctgtacgccggttgccgcaccgtggtcgcgcgacgcacccgcaccggccctgccggcaggggctcggcggtgaccaggggcgcggcgggggtggtcgaccgtacgcgcgaatcgggtcgggccgcaaccggccgccgcagtttccgcgcggcacggaccgcgaccacgatcgcgcccggcgccgccgcgacgaaggcacagatgccgtaggcgaccgcgatcgtcacgccctgttcggcactcagcccggccgcgccgaaggcccaggccagcacgccctcgcggggcccccagccgccgacgttcagcgggatgcccatcgccagcagcgccagcagcagcatcggggcgagccgcagcagcgacgcgccgttcccggcgacccgggccgcgaccaggaaggtcgccaggtgcccggcgaggaccatggccgaggcgaacagcacgcccggccagttgcggcgggccagcaggccggagcggatctcggcggccccggtgcgggtggcgccggccagtttcacgctgccccgccgggcccgccggagcaccccgacggtcagcagcgcgacgaccgcgaccgtgccggcgaccacggcgaccgtctccccgtgctcgccgaggacggtcagcaccggcgacggcacggtgaacagcaccgccccgccgaccaccagcagcaccagctgcccggcggtgcgttccaggacgaccgcgcgcacgccgcgccccacgtcgccctcctcgcggccgtgcgagacggcccggccgacgtcgccgagcaccccgccgggaagtgccgcgttcaggaacagcgcctggtagtagtcggcggtggcgtcccgcagcgacagcttcaggcccagcccgcgggccaccaggcaccaccgccacgcgctgagcaccgtggtcaccacgccgatcccgaaggccagcgcgagcgtgccggcgtcgagcacccgcagcccgtccaggaaggcgccggtgccgagtcgccacagcaccagcacgatgatcccggcaccgccgagcaggcgcacccatgcccagaacgatcgcgtcgtcactttcccgtcccctcgtcgatccctcagggactagtacgcccgaccgccgtgactcggttcagtcgaagatcgctaaaacatccttgtggcccaccgagatctccggaagggccgccgcacgctccgccagatagtcatcgaagcgcagatcaggacgctgctcggcggccgcaccgacccagccgcgcaaccattcggcggtcagttcgggccgcgccgcgccgagccgccaggggctctcccgggtgaggatgcgcgcaccggccttcgcgaaggcggccgcggcgtagtccccggcctccggtccgagacgcgcgtcacgacgctgatggtcgttgaaagcctgtcgtacgtcgtcgtcgcgcggatcggggggcgtcaaccgcaccaccccggtcaccgagagggtgaacagcacgttcgcccgggcctgcgcgcacacctcgaccagccggtccacctcggcggcggtcagcacgtccagcagcgccgaacaggtgaccaggtcggccccggtcaggtcgtcgcgggtcagcgcggtcacgtcgcgctcgtcgatcgccacgttcaccccgtccggcatccggtcggcggcgatctccagcaggtcgtggtcgcggtcggtgaggatccagaactgcggcatcggcagccggggcgccagccaccggcccatcgacccggtgccgcagcccaggtcgcggatcaccttgaccggatgcggcagcaggccggccaggtcggccgcgcgggcgtcggcgtcggcgggctcgcgcagggccagccagtcggcgctgaattctccggtcatggagttccttcctcgatgattctcaggatcgtggtgagccggcgggccgtctcgtcccagccggtcagggtcgcgcggcgggcgacggcccggcgccgccagcgcgcccgcaggtcgctgtcggtgagccaggcgcgcaggacgtccgcgagcccgtccgggtcgtccggggccaggagcttgccgggtacgccgtccggggtgccgccgagcgcctgcgggacgccgccgacgtgggtggccaccaccgggagggcgtgcgcgagcgcctcggtgatcaccatgccgtaggtttccgcgcgcgacggcagaacgaagaggtcggcgttcgcgtaggcggcctcgaggtccgccccggcgagcggcccggtgaaccggacgttcccggaatgggcggggatcgggcccgcgccggcgaaggtgcactcccagtccaggtcggtgagggtccccagagcacgcagcaggacgtcctggcccttgcggtgggtgagcgacgccacacagagcaggtggcggccgctgggggagccggtcgacggcggggcgggatcgacgccgggagccgcgacgtgcacccgggcgatgccgtgcatgccggcgacgtgcgcggcggcctggtcgctggtggcgatcaccccggcggccaggtgcagggcgcggccctccagggccttcagttcggcggccgcggttggggagaggccggtctcgtcgctgagcggcaggtggaccaggatcaccagacgcagccgacgggcgtgcggggcgaggagttccgggacgccgcacgcgaccaggccgtcgagcagcacggtgtgcccgtcggggatcgccgccatggtccgggacaggcgccggcgggcgtccgcggcggggcgtggccaggagccgggcagagcggtctcgcgtaccgccggatgatcgagcggagccgcagccggctcgcgctgcgtgccgcgcgcccggttcgcggtgatctcccgcaggacccggcggtcgtagcggttgccgccgctcggtgccgccgggtcgtcgatgccgcccggcagcaccacgtggagcggggtgttcaccgcagggttcgctcgtagctcgcccaggcgatgtgcgactcgtgcagggtgacctggaggccggtgagaccggtggcgcccgggccgagttcgcccgcggagatccggacggccagccggtcggcgatcaccttggccaggaactcggtggacgtgttgacgccggtgaactccgggtcctcgtccaggttgcggtagctcaggccggagcagatggtgtgcagcttctcactggccaggccgatgtcgacgacgatgttgtcctcgtccagctccgggcggcggaaggtggcgtcgaccacgaaggtggcgccgtgcagccgctgcgcaggtccgaagacctccccggagaagctgtgcgcgatcatgatgtggtcgcggacggtgacgctgaacaagggcactcctcggtctgaaggatctttgcaggacaacggttacccggtccggaaagatcaattcccggtggggtagtcgatcacgtgacacagcgccggcaggctgccgtcggccagcctcggcatcacctcgggcagctcgtcgaacgcggaccggccggtcaggagggcgtcgaaacggtcgtcccgcaagagattcaaggctaggtccaggcgttgcgcgtacgtgcggccccgctgcgggaggatgccgccgacctgactgccgcggatggtgaggcggcgggagtggaagaactcgcccaggcgcagggggacctcgcggtcgccgtaccagctgagctcgacgacggtcttctccggggcggcgagctccaggctgcgggccaggccggccgggttggcgctggcatggatcaccaggtcgcggccgtccgcggcgtcgtcggggagggcgaagtccacgcccagggcgtcggcgacggtcctgcggccggggtcggcgtcgacgagctggatctcggcggcggggtaggcggcgaggatggcggccaccgaggagccgaccatgccgccgccgacgatcgtgatgcggtcgccgagctgggggttggcgtcccagacggcgttgacggcggtttccaccgtgccggccaggaccgcccgctccggggggacgccgtcgggcacgacggttatctcccggtgccccaccacgtatcgggtctgatgcgggaacaggcagaagactgtccgattcttcagggaagctggaccttcctctaccgtgccgacgttgaggtagccgtatttgaccggcgccgggaagtcgccctcctggaacggcgcccgcatcgccgaccactggttctccggcacccggccctggaacaccagcgtctccgtaccgcggctcacgccggagtgcagcgtgcgcaccagcacctcacccggacccggatcccgcaccgattccgtgcgtatctcccccgatccggggcaagccaaccaaaaggccctcgcgtcgaacacgaaccaactcctctgaaccgaaagtcctcgacaagcgtgtgagtggaggacagcggttagaccctaagtccaggaggcacggtgaccatcactaccgccacgacgaccccgtcccgggcgcctttcgccgggttcgccgcccagctcgcgctgatcgcgctgctggccgcgacgacgggactcacgctggccggtgggctcgccggaatcgcctacggcgccgtcctctgcggtctgctcggcatggccctggaccgggccgggctcagcttcctcggctgggccaacctggtcaccttcggccgggccatcctcaccggcggggtggccgccatggtcaccggcaccgtcctcggccacccggcgccggtctggccgctggtcacgatcgccgccgtcgcgctcgccatggacggcgtcgacggacaggtcgcccgccgcaccggcacgtcgtcgtcgctcggcgcgcgcttcgacatggaggtcgacgcgttcctgatcctggtgctcagcgggtacgccgcggtcagccacggctggtgggcgctggccatcggcggattccggtacgccttcgtcgccgcctcctgggcgtacccgtggctgaacggcgcgctgccggcgcgcttctcccgcaaggtggtcgccgcccagcagggcgtgctgctcgcggtcgtggcgaccgggctgctgccggagtgggccgcggtgggcacgctggccttcgccctggcgtcgctgacctggtccttcggccgggacatcaggtggctgcaccgggagtccgcggtccagcgtcagttcgacctgatcactggacgcgtctgaccgctccctggcgtgccgccggcaccgcgtccggatgcaggatcgtggcgatcgcctccaccccgtcgaccagccgcggacccggccggaccaccaggccgtcgccgtcgatcgcccacacctgcgcgtccgggaagtgcggcagcaccgactccgcctgccggaccgcgccgtccaggtgatagccgcacggtgtgaccagcacgatctccggttgcgcggcggtcagctcggcccacgacacctgcaccgaccgcttccccgcccgcgccgccaccggctcaccacccgccgcgacgatcagatccggcacccagtgcccgccggtgaacggcggatccacccactccacgatcgccacccggggccgcggccggccggccaccgcggccgccaccgcgtccagccgccgctccaggcccgctctgagttcccggccccgatcgggtacgccggcggcagtggccacctcgacgaacgaggccagcacgtcgggcagcgaatacgggtcgagactgagcacctcggcgcggcagcccagatgcgtcagcgcgtcgtccacatggccggacgggagcgcgcagacccgacagaggtcctgggtgaggatcagatcgggggagaggccggcgagggcgtccgcgtgcagggtgtacagatcaccgccggcggccatctgcgtacgcacataatcgtcgatctcgaccggcgacatgccgtgcgtgtcccgcccgccgaccaccaccgtcttcgacgagcgggcctcggccggctcgtcacactcgaaagtgaccccgaccagattgtcacccaaccccagcgcatagacgatctcggtggccgagggcagcagggaaaccagacgcatacctgtgaccataggccgaaagtcggactccggggtcgcggaataccaccccggtccgatgtgcccggcgctcgccccgatcgatgctggacagcagcttcgagaaggagacccgagatgacgacagcaccgctggcccacgccgacacgctcgtgctcgaatacctgaccgagttgtggaccgcgagcgaggatctgccacccggcccgcgcgacgaactcatgcggaccgtcaccgactacctggccgcacggcaggaacccggggccgaccccggaccggtgctgtccaggatgggtaccccgggacaactcgcggaagcggcccggcgcggctatctgccgctgcgcccgccgcgccacccggcacccgtcatcgcggcgccgacggtgccgctcgtcggcggcgccgaattcacggcgatcgcgttgctcgtgggcgggaacttcgtgctgccggtggtgggctcggcggccggcatgctggtcgcgagcgggtcgtcgcggtggtccggatcgcagaagggggccgggtgggtgctgtgcgccggcggcccgggggcggcgctggtgctggtgacactcctcgcgagcatgggtttctcggcggcgccgacgctgttcctggggtatctggcggcttgcgcggggtcggtgggggcgggcctgatgctgttgggtgggctgcgggcggggcctgggcagcggtgaggaccgcgggccgggccgtgtggggcggttgtcgtggttcagtcggtctgaggttacgcggatgcgggatcgcactgcggcgcgaaatcattctgacgaggaagatcaattttagcgcgagcacgagcgactccggccccggtctcagccccggtccatggttcggctccgcctcagccccggcatcggctcggattccggtttcgggctccggccccaggtttcgaccctgaccggtttcaggccccgattccggccctggtggcctgtttcctctgcgcatcgagggaaggtttttcggagctgaccgggacttgtcgtgcatcttcgagcggggctgcctcagggtgttttccgggcgaccttgaatgtatttcttgttttttggttgtttggtgaagggcgtgttgttcggtcaaggcgtgcggaggatttcggggaggatctggggccatagggctcggggtgggggttcgtggcctacgccgtccagccagatcaggcgggcctgggggatgaggcgggccagctcccgggggtggtgggcggggacgcgctggtcgagggtgccgtgcaggatcagggtgggggtggtgatggtggggagccggtcgtggatcggggggccgtagccggctcgctggtggttgcggcgggcggtgccgaggtcgcaggagcggtcgaagactcgttcggccaggcggcgcaactgctgctcgtcgggggtgaacgggccgccccgggcaagggcctcggcgatcaggccggctaccgcggcgcggcggttggaccagttgacgtcgtcgggggcggtgcggacggcgaccgaggtgccggccgaggtgcggagcgggagagtgggggcgccggccaggaccgggatggcgtccggggggaggccggcgctggtggcgatcaacgtgagggtgagggcgcggcgcgggtgttcgacggcgatgcgctgggcgagtgcgccgcccagggagaggccgaccaggtgcgcggcgggggcgccgagcgcgtcgaggacaccgagcgcgtcgtgcatcaggtcggtgccggaataggcggcgccgggtgggaacgcggtggagcggcccgtgtcgcgatggtcgtagcggatgacgaagcgaccgccggcggccaggcggcggcagaactcgtcatcccaccagtccatcgaactggcctccccggcgagcagcaggagaggcggatcggtgcgttcaccgaaggtttccaggcacacctggatgccgttgaccggcatcatcgtctcggtcaccaccaggccattgtggtggcgctcaccgacagccaggttaaatgcggatcacaacggatgacgagatcgaggtgacccgaccatggttcactcataccgtgaaatttcctgaaatgtcggaattcgagctgcaccgtacggaagagcaggcctcgctggacgggcagcgggtgccggggctgcgggccgagttcttccgccgggccgacggggaccgggtcgccagcgtggggcggtattcgctgggcgggcgcgagttgctgctcgcgtgggggtacgtcgacgaggagcattgccggcacaacgccgtacgcgcgaaatccggaagttggtttccggcggaagccgggtgtcccgacgtgcggctcataaaggacggccaggccgtgatcggcctggccgttcgcgcctccacgggcgaatggatgcgcgaggagtgcggctgagggcgcgggtggcgccgggcggaaagcgggcggcgcgggtgcggtgcgggccgcgggtgcaccaggagtgcaggtgagggtgcggcggggcggctagcggggtttcggggccgggacgccggcggcggcgcgggaccggttgcggacgatgcgcagtgaggttgcggtgaggccgatggccagcaggaacagggccaggtgcaggtacgggttgatgatcgggacgaaaccgatcaccgcgaccgggatctgcaccaccgcgatcagtgcggccatcagccacctgcggcggccgctccacagcatcgcggtccacaccggggacgccacgaccagcagggtcagcgcgtcgagcacggcgtggaagtacacgttgtggacgttgttgtgggcgaacgcctgggccggcgaggcgatccacagaccggcgacgacgagggcgagaacgacagcggcacgacgcatgggttcctccagcgttatcagaccgttgctcggggtaaccacggtataaaagcggcaggcggcgcgtaaaggttcaccgggattcattcccgcgagatggcacagtcgctgtccgtgttgtcgaccttgtccgaacggctagctgttaccccgggtgatggtaactagcctgcatctgtgcgtttgatcgagatagctacggcatgtgcagtcactgtcagtgctggcggtgcctcttacgtagcgttaaatccggagaagttgagggccgacgcccaggtggtggccgacagggcgacctgccgcaccgtggagtcggcgatcgtcgcgtacatcgcggtgcacgacgccgacccgacgtcgatcaggcaattgacgccgtacgtcgacggcgacatcgcgaagtaccgcatcgtcaggggccgcgcggcggggccgggctgccgctgatgccgtggcgccgtccgcagcggcccggtcacgtcatacgatcgggctgaaacaccggacaaggacggaaacgggtgacgatggagacgttggagttccaggccgaggcgcgtcagctgctgcagttgatggtccactcgatctattcgaacaaggacatcttcctgcgtgagctgatctccaacgcgtccgacgcgctggacaagttgcgcctggccaaactgcaggacgggctggaggcggacacgtccgacctgcacatcgagatcgaggcggacgccgaggcgcgcacgctgacggtccgcgacaacgggatcggcatgacccgcgaggaggtcgtggcgctgatcggcacgatcgccaagtccggcaccgccgacctgctggccaagctgaaggaggcgtccgagtccaagggtgacgccgagctgatcggccagttcggggtgggcttctactcgacgttcatggtggccgacaaggtgtcgctggtgacccgcaaggccggcaccgaggggcacggcacccgctgggagtcggccggcgagggcacctacacgatcgaggacgcgccggacgcgccgaccggcaccacggtcacgctgcaactgcgacccaaggacgaggaggacgccctcttcgactacgccgacgagtggcggatcaagcagatcgtcaagcggtactcggacttcatctcgttcccgatccggatgggcgacgagacgctgaactcgatgaaggcgctctgggcgcgcccgcgcagcgaggtctccgacgacgagtaccaccagttctaccggcacatcagccacgactggtcggacccgctcgagatcatcaacatgaaggccgagggcaccttcgagtacgaggcgctgctgttcatcccgtcccgcgccccgcacgacctgttccagcgtgacgcccgccgtggcctgcagctctacgtcaagcgcgtcttcatcatggacgacagcaaggagctgatcccggactacctgcgcttcgtcaagggcgtggtggacgccgccgacctgtcgctgaacatctcgcgcgagatcctgcagcaggaccggcacatccagatgatccgccgccggctggtcaagaaggtcctgtccacgatcaaggacctgatggccaacgagccggagaagtacgcgacgttctggcgcgagttcggccgggcggtcaaggagggcctgctcagcgagccggacaaccacaagccgatcctggacatcgcctcgttcgccaccaccgcgggcgccgagccgaccacgctcgccgcctacgtggagcggatgaaggaggaccaggaggagatctactacctgaccggcgagagccggtcccaggtggagaactcgccgcacatggaggcgttccgcgagcagggttacgaggtgctgatcctcaccgacccggtcgacgagatctgggtcgacgcggtccccgacttcgagggcaggaagctgcgctcgatcgcccgcggctcggtcgacctcaagaaggacgagccggagaaggagcccgagggtgacttcgggccgctgctcggcttcctcaaggacaggctggacgagcaggtcaaggaggtgcggctgtcgcaccggctgaccacctcggcggcctgcctggtcagcgacgccgacgacatcaccccggcgctggagaagatgtaccgcgcgatgggtcaggacggcccgcgggtgaagcggatcctggagctcaacccccaccatccgctggtcgccggtctgcggtcggcgcacgagcgcggcgcggaggatccggctctgccggagaccgccgaattgctgtacgggacggccctgctcgccgagggcggcgacctggaggatccggcccgcttcgcgaaactgctcgccgatcggctggcccggacggtctgatttccgatcctcgatggacggccccggagtattccggggccgttcgcgggttctgtgaccgtggtcgatgtggctatgctcgatcaatgaggtgccaggcctgcgggttggacaacgatccggcactcgactattgcgacagctgcgagcatccactgcgcgattccaccgccgttgtttcggtgccgccgccgccgattccccggccccggccggcgccggccgtggagttcgacgacgcggggacggcggccgatccggggttccgggacacgctggtcgagccgcgcccgccggcccggccggtgctggtgggggtggccgtgctcgcgctggccggggcggtcggcggctacctgctcgcgcaggatagaggcgataaatccggcaagccggatagcggagcggtgaccagtgcggccgcccggccggtcgggggtgggacggacgccgcgcggggcggcgcgaccggcgcggacgacggcgatggcggcccgggcagcggggatggcggcccgggcagcggggatggcggcccgagcagcgggaacggcggacccagcagtgccgcggccgacccgcaggcccagggtgccgcactcgataagctgctcgatcggagcagggccagccgggacaagctcaaccaggcgatcaagtcggtcgacgggtgctccggcgtgtacgccgcgatcggccggatgcgcgaggccggcgacgagcgtgccgccgagcgggacacgctcgccaccctggacctgtccgcgttcccgaacggggagagcctgcgaagcgcgctgacatcggcgttcgagcattcgctggccgccgaccagaattatgtgaaatgggctcaggaaaagcaggcgaacgattgccggaatacgccggcgacccgcgcctacgacgccgacggagaccgcgagtcggactccgcgggccgcgcgaaagagcaattcctgggcctgtggaatccgatcgccgggcagctcggcctgcagacgcgggaccggcagggcatctgatcagccgccgtgcaccgcggcgaccagggcggcgaccgcggccagcgccgccgtcccgtccggggcgtaccggtgcaggtcttccagcaggcttcggagccggcccgggtgggccaactcggccgccggcgccgcctgcagctcgctcaccgcgtggccggccgccaccgggtccgggaagtcggccagatgctcgcgcacccggccgagaagctgcgccacggcggccgcgtccacgccgtacacctgctggttgaaggtgttgtgatcgccgccgaagttgttctggccgccgttcacgccgccgatgttgaaggtgttcgagtcaggcacgcgccgctcctaccgtcgtggtgaacacgttgccgtcgccgccgaagttgttctgcccgccctggatcgtgcccacctggaccaggctgctgttctgcagcgtgatctggttgaccgcctggcggaattcgagcgggtcgacgccgttctcgatcaggtggtcgatgatcgcctcgccgacgatccggtcgaccagcttcacgtacttgatgccgtcgagtctctgcaggtagctttccgcctccggggccgaggccaggtcacggacgctgatccgcgcgccgtagtcgtgggtgcggaactcctgcgagcggcggatcgaggtgtgcatccgccagcgcagccgggccacccggccgagcgcccgggccaggcggtacggcccggctgccacgtcgacgatcgccccgcgcagcaccccgcccaccgcgtacgagccgaccttctccgggcgcagcgtgtcggcgacctggcactcggcgcgcagcggtggcagcacggtgccgagaaactcggcgtacagcatcccgccctcgaccgcgacgtgcacgaacgcgctgaccgagatgcccagcgcctgcgcgccgaggatcacctggccgtgctcgtcccggatcgccttgccgcgcaccgggatcaccacccgcaggtactgccggagcccgccctgcgggctggccacgatcgcgtcgacggtggggtcgtcggccatcgtgtacggcatgccggtctccgggtcgatcaccggatcgtgctcgtcgcgaatgccgtcggccaccacgtacggccggaccgacaggccggtgacccgctgtccctcgtcgagccagtcggcgcgcatcgtctcgatggcccgtttgagccgccggttcagcgccaccgggtcgatcggcaccggctcctcggggcggatcccggacgggtcccgcggccgcagcgtcatgctgaacgaccagccctgctcgaccgcgccgcagccgaggaacgggtcgtcgtggtggaccaccacgttgccccgctgggctgcggcgatcatcgcgagccggtcctcgaccagggtgtcgcgcagccgggtgcgggcgtgggcgacgtcgggggcgaactcggtggtgacgacccggtacgcgtcgcggcggaacgcgtaggtgacccccacgatggccagcaggcacaacagggcgagcagggagctcccgccaccaccggtggcggctgccgcggcggcggagccggtggtgtcggtgttctcgtcgaggtactgccggaagaggttctggagggagaacagcagcgtcagcggcagcccgaccagcatgccggccaggaaccaggcgacccaccagcgcaggaagccgaggcggtggcgggccaggaacgcccgcagccgcaccgagcgggccagccggacgatcaggccgagcccggtcacggtgagcgtgagcggtgggctgagcaggagcgcggccaggtagagcacggtggcgcagagctgctggtagaggtgtcggcggcggacccggaagcactgccggacgatcgggtcgaggtcgtagccgtgcgagggcggcacggaccggcgcatctcgccgatcagttcgtcgaccacctggtcggcgaagccgcgcaccaggaaggcggcggtgcacagataccgggtggtgttgctgaggcggtcactggtccgggcgtaccgcggcatggtgagcggcgcggcgagcggcgggctgggcagcgttgtcatcggcgtcggtccggagtcgtcggagatcctgatcggaccgacggtaggcgggctcactcgccgtcgtcaatggactaccggggggacggcggcgtcagcctttcgccaggttgacgaagaacgtgccgatgttggtgaagatcgtggcgaccccgtcgccgatgctccgggcgacgtcggcggccggccccgggttcgtgccgatccagaagacgagcaggaacaacagcacccagccaaggatcttcttcatgtcagccccacccccatccatgatcctcacacacgccgggtaccgcccgtgagcggcacgcccaaccctgagaggactctgaggaaagtggaagctacctttttttgagagttactgtcattttctggagaacacgaaagcgcgctggttcgcgctcgccgccctggcgttctgcacgctcgcggtcggtctggacggcacggtgctcagcgtcgcgctgcccacgctcgcccacgacctgcacgccaccaccggtgacctgcaatggttcaccacctcctacctgctggtgctggccgccgcgctgctgccggccggcatgctcggcgaccgcttcggccgcaaacggttcctgctcggcgcgctggcactcttcggcgtcgcctccgcctggtgcgcgtgggccggcagcaccgggcagctgatcgccgcccgctcggtgctcggcctggccgccgcggtgatcatgccgctgatcggcgcggtgctcaccgtcgtcttcgacgagcagacccggccccgggcgctgagcatctgggtcaccgccaacgcgctgggcatcccgctcggcccgctgctcggcggctggctgctcgaccacttctggtggggctcggtcttcctgatcaacctgccgatcgtcgcgttcgggctgctcgccgtcgtggcctgggtgcccgggtcgcacggggaccggacccgccgggtcgacctcccgggagtggcgctctccgcgatcgggctggtcggcgtgacgtacggcatcatcgaagccggggagcgcggcttcggtgacccgcgctcgctgctgaccgtcgccgccggcctcgcgtccctgatcgccctggcgatctggcagcggcgtgccggcagcccgctggtcgacctcgacctgttcgcctcgcgcggtttcaccggcggcgcggtcctcgccacagtcgccagcttcgccttcttcggcctgctcttcgcgctgccccagctgttccaggcggtcggcggacaggacgcgttcggcaccggcatccggctgctcccggtgatcggcggcctgctcgtcggcgcccggctcgccgaccgcctggtcgcccggctgggcccgcggatcgtggtcgccaccgggctgaccctgatggcgctcgccctgctgaccggcgcccgcaccggcgtgaccacgggatacggctacgtggccgcctgggtcgcggtcgccggtctcgggctcggcttcgtgatgccgccatcgatgaacgccgccctgggcgccctcaccccgcagcgcagcggcgtcggctccgggctgctgcaggcgatgcgacaggtcggcagcgcgatcggcgtcgcggtgctgggcaccgtgctgaacaccggctatcgcgacgggatcgacgcggccgggctgcccgccgcggcccgggacagcgccgccgccggggtcgccgtggcccggcgcgccggcgacccgggcatgctggacaccatccggcgcgccttcacccacggcatggacaccgcgctggtcgccaccggggtggtcgccgccctcggcgtcctgctcgtggtgatcctgccccgccacgccccggccgccgacccggcgctgctggcagaatcaggagtatgacggcgagcctgcgcgagcgtaagaaggcgaggacgcgggcgacgatccgcgagcaggcgatgcggctgttcgaggagcaggggtacgcggcgaccacggtggaccagatcgccgaggcggccgaggtgtcgccgagcaccttcttccggtacttcccggccaaggaggacgtcatcctggtcgacgactacgacccgctggtggtggcggcggtccgcgcccagccgccggaggtgccgccgatcgaggcgatccggcgggcgctgcgggacgtgttcggccgtgtcagccccgaactgtgggagctggaacgccgccgccagaaactcttcgccgaggtgcccgagctgcgggcccgcgcgctgcaccagatgaccgaggcgatcgagctgatcgccgaggtgatcggtgagcgcgccggcctgccgcccgacgacctgcgggtgcgggcgatgggcggcgcgatcgccggggtggtcctggcggtgctgccgccgggccggatgatcgggcagaccgctctcgacccggccgatttcgagcggctcagcgacgccctcgacctgctccagcagggtttaccgctcggttagcgcctggcgggcgctgtccagcaggcgttcggagagggtggtgccggccgtggcgcgggccaggatcagggcgccgaccatggtgctgaccgcgaccaggtcgggttcggcgccgccgagcatccgcgcgtaggcctcgaccccggcggcgtaggcctcgcgggccgtctcgccgcccgctgcgcgggcgacgtcgccggcgaatccggccgtcgggcagccctcggcaggctggtcccgatgctccatggagaggtacgtacggatgaagtccgccggccggctcggtgcgcccagtcgcgcggcctgctcggcgaaagcgtacgcgatcgcctcggtgaccagtgcgtccttcgacgtgaactgtttgtagaagccgccgtgggtgagcccggcggccgcgctgacgtcggccacgctgaccccggcgatgccccggtcccggaagagggcggcggccgtggcgacgatccgctcccggttctcccgggcctgtgcctgcgatacccgtcccatgcgcccagtatagatgacgtgtgtcatctattaccttgcggacttttagatgacgcccgtaatctaagtcgcatggaacttcacaacgccgtcgccctcgtcaccggagccaaccgcggattcggccggcacctcgccgcccagctgctcgaacgcggcgccaaggtgtacgccgccgcccgtcgcccggagagtgtcgacctgcccgggtccatcccgctgcgcctcgacgtcaccgacccgacctcgatcgccgccgccgtcgcggccgctcccgacgtcaccctgctgatcaacaacgccggcgcggccagcggtcagccgctgctcggtggcgacctggacctggtccgggccgagatggagaccaactacttcgggccgctggcggtgacccgggcggtcgcgccggtgatcgaggcgaacggcgggggagcggtgctcaacgtcctgtccgtgctgtcctggctgcacccggcggggctcggctcctacgcggcgaccaaggcggcggcctgggcgctgaccaacgccacccgcgagcagctggccccggccgggatcacggtgaccggactgcacgtcggctacatggacaccgacatggccgccggcgtcccggccgagcagaaggccgatccggccggggtggcgaaactggcgctggacgcggtcgccgccggggccccggaggtcctcggcgacgacctgacccgcaccgtgaaagcgtccctctaaaggaacagcctgccctgctcccgggcctcggcgtgggcagccttgcgagcggttccggcgtcggcggtcaccaggttgggccggaagtggatctcggtctggtcggtgacgccggcccagtgcagccagtcggcgaaataccgggactggaagtcgctgccgaaggcgggcggtcggtccggcccgtacaccgcgctggtgtagaccaccgcggccttcttgccgcgcagcaggccggtgtagcccgcggccgggtcgaagccgaacaccaggccgggctggctgaccacgtcgatgaactgcttgaggatgtacggcacgccggcgttccacatcggcacgctgaacaggtagcggtcggccgcgtcgaaccggtggaacgcggcgaccgcggcgtcccacgccgggctctgcggctgctcgccggcgaagacagccatcttggcggccgccgcgtccggcccgaactcgggcagggtcccgtcccacaggttccactcctcgatctgcaggccggggtgggcctcggcggccgcggtcaggaaggtggccgccagggccagggattcggacttcccgccgcgcggggaggcggcgatgtgcagcagcttcacggtcttctcctcgatgtctcatagtgcgtgcgcacgcacatttttacgcctgatgcgtgcgcacgcacaagatttcggtaggctgcggtgatgagcgacaccgaaaccgccgcctgggccgcgctgttgcgggtgcacgcggccgtggtgccggtcctcgaccgcaccctgcagagcgcctgtgggctgccattgacgtggtacgacgtgctgctggagctgcgtcacgcgccggacggccggctcagcatgggtgagctgggggagcgggcggtggtcagccgcacccgggtcagccgcgtggtcgaccagctcgtcgcggccggcctggcgacccgggagaccaatccggacgatcggcgctcggcgcacgcggcgatcaccgacgccggccggcagcggctgcgcgaggcggcaccgatctatctggacgggatccggcggcacttcaccgggctgatgtccaccgacgaggcgcgcgtggtggcccgggccctggacggggtgctgcggaaacaggcgtgaaaagcgccacggcggggtaaccgcgcgtcatgtcgaccatcaccgatgccggcaccggccagctgatcgtcgccgcggtgctcggcatcgcggcggtcgtcctgctcatcgccggggccaagtggcatccgttcctcgccctgatcgtcggaaccggcgtgctcggcctggtggccggcgccgacccggccaagatcgtcacctcgttcaccaccgggctgggcagcacggtgggcagcgtgggcgtgctgatcgcgctcggctcgatgatcggggcgctgctgaccgagtcgggtggcgccgacgggatcgtgcaccggctcgtcaccggggtctccgggaccgtcctgccctgggcgatggccggggtggcggcgctcgtcgggctgccgctgttcttcgagatcggtgtcgtgctgctggtgccgatcgtgctgctggtggcccggcggaccgacgtggggctgctgcggatcgggattccggcgctggccgggctctccgtgctgcacggactggtgccgccgcatcccgggccgctggtggcgatcgacagcctgcacgccgacctggggctgaccctgatcttcgggctgatctgcgcgattcccacggtgatcgtcgccggcccgctcttcggcaacctcatcgcggcgcgcgtgcccgtcgacgtaccgcgccgtcctgacgttgatcttgatgctgacggtgccgcggagcgggaaccggaagccgtgcggcgcaaccccggattctggccggcggtgctgaccgtactgttgccggtggtgctgatgctcgcgcgggcggtcgcggaactcaccctgcccgacgacaacagcgtccggaaggtcctcgacgtgctggggacaccgatcgtggcgctgctcttcggggtgctgctggcgatgtggagcctcggtcaccgggccggcttcgaccgccgggagacctccgggatcgtcggcggcgcgctgcccccgatcgccggcatcctgctgatcgtggccgccggcggcggcttcaagcaggtgctggtcgacagcggcgtgggccgggtgatcgccgacgcggccaaggacgcgagcatcaacgcgctgctgctcggcttcctcgtcgcggtcgggatccgggtcgcgaccggctcggcgaccgtcgccacgatcaccgcggccgggatcgtcacgccgctggcggccaccctggaccggccgacgctgtcgctgctggtgctcgcgatcggctgcggctcgctgttcttctcgcacgtcaacgacgccggcttctggctggtcaaagaatacttcgggatgaccgtcgggcagaccgtcaagacctggtcggtgatggagacgatcatctcggtggtcggcttcggctgcgtgatgctgctcagcctggtggtctagcggctaaccgcaggtgccgtcgatcttctggccgacggtgctgaactcgccgttcaggaacgccttcgggtcgtccgaccggctccccctggtcagcgccgcggccacctcgtccaccgcggcgcgctgggcggcgtcgtccgacttcgccccggccgcgtgcacctgggtggccatgtcgccgaaggtcttctgcaggccctcggtggcggtgtcgtcgctgccggcggcgaatccggccagcttgaccgcgccgtcggtgaggatcttgtagaccgcggtgcagacatacttcggctggccggccgacgcggacgggaccggcgcgacgctgaacggcgccggcatcgaggcgggattgaccttcacctcgcacccggcggccagggccagcgtggcgatcagggcgacgggtacggcgatccgcacgggcattcccctttctcgactccagtacgcggcagcataatgcgccgcgacaccttttgcgcggtagggaagttagctacgaacgtggcgaaattcccgaaaaatgccttcatagtcggtacgacggtggtagtactggctgccggtggcaccgcgttcgccgacctcgtctcgcccagcccggtcacctccccgtcgttcaacggctcggtctacgccgtcgcctaccgcggcagcacggtatacgtcggcggcaacttcacccgcgccatcgtcggcggccgcaccgtgccgcgcacccggctggccgccttcgactcccggaccggggcgctgctcgactggaaacccggcgccgacgccaccgtgcgcgccctcgccgtggacagcgacacggtctacgccgccggcgacttcgaccagatcaacggcgtgaagcgggacgcgatcgccggactcggcgccaccgacggcgcgctcaccccgatgcggcacaccgtcctcggccagcccgccgcgctcgccgccggacacggcaaggtctacctcggcggccggatcaccgcggtcgacggagttccgcgggccaacctggccgccttcgacaccggcaccggggccctcgacccctgggcgccgaccaccgacgacaccgtgcgcgcgatcgcggccgccgccgaccgcatctacctcggcggcagcttccaccggaccgacggcgcccgatacaccctgcggctcagcgcggtcgacccggtcaccggagtcctcgacccgaccttcctgcccaagccggtctcccaggtgttcgcgctcgccgcggccgccgacggggtgtacgcggcactcggcgggcagggcgggcgggcggtgtcgtacacccggaccggggccacccggtggacccgggtcttcgacggcgacgcccaggcgatcaccgtgctcggcggcaccgtctacgtcggcggccacttcgacaaggcctgcaccaccaccaacaacggggccaagggcagctgcaccgacggctcggtgccgcgcggcaaactcgccgccgtcgacccgcagggcaacctgctcgactgggcgccgcaggccaacggcgtcgccggcacccggtcgatggccgccaacccggagatcagctcggtcagcgcggtcggcgacttcaccaccgtgggcgggctgccccgtaagcggtacgccgagttcggggcgatcgggccgcgactcgaggacgcgccggccaccgcggactacgtggcgtcgtacaacttcgactcgaccgtcgccgacggcacctacgacgacgggtccggccacggccacctgctgcgcgccgtcacccgccacggcggcacgacgaccgccgtgccgcacggcaacggccaggcgctgcgcttcccggcccgatgcaccggacccacctgcccgcgcctcgtcctggaaaccgcctccggacccgacctcaacccgggaacccggcccatccgctacggcgccggcgtgcaactcgccccggccgagacctccagcggcgagaacatcctgcagaagggctactccaccggcggcggccagtacaagctgcaggtcgacggcatctccggcaaacccagctgcggcctcggcgaccaggtcgtctacctcgcccgcagccgggtctcgatcgccgacggcggctggcacagcctggagtgccggcgcaccggccccaccctgtccctgctcgtcgacgacgtgctgcaggccagcgtcgccgtcccgcccaccgtcgcggtcgacaccacctccccgctcaccgtcggcggcaaaggcgccggcccgaacaacgaccagttcaacggaacactggatgacgtctgggtgcacatcgggtaggtgtcgtaccggtccggtaccttgcccgcatgtctgatctcgaccgactcctcgaggccggttcccgccacgttcaggacgacgtgacctacgtcgtcgagccgcacccggccggcagcctggtcctgccgaccgggcagctggccgccttcgacccgggcgtcaccgacgaggacgaggagccgttcacggtccccgtcacccccgggacccacccggtcaccgcctgggtcgcgatcctggagaaagagggccgcgagtggcagcggcgggtggcggcgctgcaggtcaccgtgcgaccgggcgtggtcatgtcgtgggagctggctctggtcgccagcgacgagccggcggatctcgcgcccggcgagttcttcggctacggcgtcgagaccggggccggcggcttcgccgacctcagcgtctcgcggatcctggccgggtgggacaccgaggagttcgaggagaccttcgaccccgacgagttcccggaggagccgatcccgggccacttcgaccacgtgatcgacccggacaccggagccaacctgatcatggcggagtcggggtggggagacgggttctatccgacctacgtcgggcggaccgcggacggcgaggtggcctgcttcgtgaccgacttcctggtggtgccctgagcggtgccccggtgcggtatcgccgcatcggctcggcccactgatgcaggcctctgcgcaccgcaggagccgacagcgccgcgaccgtcgggaatggacagtccggtggccgacacctaggctcgcaaacatgtctttgcgggttggtgggaagcaggatcaggtgacgctgcgcgctgtcgctcacccggcccgactgcacatcctgtcgctgctcaccggtgcaccgatgacggccgccgaggtggcccgcgagctggggatgaacagcgccaatgccgcctatcacctgcgcacgctgtacaccgccggggtcatcgagctggccggtgcggagcgcattcgcggtggcctggccaagcggtaccggtacgacgccacccttcatgcggcccgcgcgtctgccggcggtggcgcgccggagccggaccgggccgtctacgccgcgatctccggcgagctgggacgccgtgcgcagcatgccgagcccggtggtgtcaacgccctcgccgacgccgagctgtgggtcgatccgcgggtgtggcgtgccgctcgggaccggatcaatgaggtcgtccgcggcctccatgaggcggcgcagaaaccccgcactccgggagcgctacgcacgagcaccacggtcgcgctgttcaccatgaaggcgacggcgtgagagtccacggccctcttgcacacgcaccgttccgattcctgctgtccggccggttggtcagctccctcggtaacgccatggctcccatcgcgttggcgttcgccgtcctcgacctgaccgattcccccggcgcgctcggcttggtgatcgggtcccgcaccatcgccaacgtcgtcttcctgcttttcggcggagtgctcgccgaccgcctgccgcggcacctggtgatggtcggcaccagcgtcgccgcgggggtcacccaggcggcgatcgccgcgacgctctcgaccggcaccgccaccctgaccgtcctgacgacactcagtgcgttgaacggcgtgttcagcgcgctcgcgatgccggcatcggcagcgctgctaccgcaaaccgtgcccgccgaggaacgtcagcaggcgaatgcctggagccggttgttcctcaacggcgtggccatcgtcggggcggcggccggtggggtgttggtggccgcggtcgggcccagctggggtatcgcctgcgacgccgccaccttcttcctcgcggctctgctgttcgtgttcgtcaggacgatgccgaccgaaccgatcggcgctcaccccctaccggacccgccggaaaccggcgtcgtcccacctgacgaggctcccggtggcggaggcatcgtcaccgatctgcggaccgggtgggcggaattcagctcgcgaacctggctgtgggtcgtggtggccggattcgcgctgatcaacgcctgtatcggcggactcaccacgctggggcccgtcgtcgcgaacaccaccttcggccgcgcgacctggggtttcgtgctggccgcggagaccgtcgggatgattgtcggtggcctcgtcgccctgcgactgcgggtcagccgccttctgctgttcggcgtcgtctgcgcggccttccaactactcccgctgttgaccctcggcctcgcgccgcggccgggcttcctgctcggcgccgcattcatcgccggtgtgggggtggagcagttcggcatcgcctgggagaccaccatgcaggaacacgtacccgccgagagactggcgcgtgtctattcctacgacatgctcggctcgttcatcgccattccgatcggccagctgctcgcggggccgatcgcccaagccgtcggtgtccggcgcacgctggtcggtgcggccctgctcatcgccgtcgccgtggtcggcatgctctgcagccgggacgtccgacacctgcgccaccgcctcggatcaccggcggacgcccagccgatcgaggcctgagcaggcgacccgtggtgcaccgtcctcggccggaggcgggcgctgaccgggccggccacgtgccgcaactgcggtgatgcaccgtcctcattcgggggtgggactcgacccggccaccacctacgccggtcccgccgagccgccgatgtggatgagaccggcgcggtggcgcgtgccgtgggatggggcgcggcttgcgatcgggggcggcacgggatggggcgcggcctgcgatgggcgcggcggggatggggcacggcctgcgatgggcgcggcggggatggggcgcggcgggtgggcttacggcgtacatccgcggggttgacggtgacgtggggttgccctgcggtgcggtcaggcggtgtggtcggggaaggtgctgagcagcgaggtcatccacggttgtggggggacggcgccggggcccaggatgcgcatcgtgccgagcacggtgatcagcatgcccatggcgaagaagtcgcgggcctcctccggggtggcgccggtgaggtcgcggacggtttggtacatgttgccgtaacaggctcggacggcgtcgccgacgaccgggtcggcgctggcggcgaagccgtgcaggaggacggcgaggagttcgcgctcggcgagcaggtcggtgtaggcgctgcccaggctggccagagtcggctcccggtcggcggccgcccgccatgtcgcctcgatgcgctggccggcgtagcggaccgtggccaggaacagctcctgcttcgagccgaagatgcggatcacgtacggctgtgacacgcccgacaggcgggccacctcgtcggtggacgtgccgacatatccgccctgggcgaaggcctgcagggcggcggcgacgatctgctcctggcgttccgcggcggtgagacggatccgagacacgttgacaggttatcagttgatgcttacggtcttagttatcagcggataacaacttaggggtacgtcgtgaccaccctcgcttcccgagcacccgccaagacccggccgttggcggccgtgctcgccgccgtcggcatcccgaccttcatggtctccctggacaacctcgtggtcagcacggcgctgccggtgatccgcaccgaactgcacgcctcgatcaccgacctgcagtggttcgtcaacgcgtacacgctgccgttcgccgcgttcctgctcaccgccgccgcgctcggcgatcggctcgggcggcgccggatgttcctcggcggcatcgtcgtcttcaccctcgcctcggcggccgccgcgctgtccaccgaagcgtggcagctcaccgcctcccgcgcggtgcagggactgggcggggccgcgatcaccccgctggcgctgaccctgctcgcccgggcggtcccggcacacctgcgcaacgcggcggtcgggatctggggcggcatcaccgggctcggcgtcgccgtcggcccggtcgtcggcggcgcggtcgtcgacggcctgcactggtcctggatcttctggctgaacgtgccggtcggcgtcgtcgccgtcgtgctcgccgcgaccacgctcgacgaatcccgcggcgacggccgccggctcgacccgatcggcctgatcctgtccgccggcggcatgctgctgctgatctggggcgtcgtcgacggccccgaccggggctggaccagcggccgggtcccggtcatgctcggcgcggcggtcgtgatgctcaccggcttccttttctggcaggcgcgcaaccggaccccgatgctgcccctccgcctgttccgcagccgcggcttcagcctggtcaacgcggtgaccctgaccttctccgccggtgcgttcggctcggtgttcctgctctcccagttcttccaggtggtgcagggcgccagcccgctgcagtccggcctgcgcaccctgccctggacggcggccccgatgatcgtcgcgccgctggccggcatgctggccggccggatcggccagcggatcctgatcgtcgccggtcaggtgttcctcgcggccggtctgctgtggatggccctcggactgtcggtgaccgcgtcctacacctcgctgatcggggcgttcgtgctcgccggcatcgggatggggctgaccttcgccccggtcagcacgatggtgctggccagcgtggacgtgaacgagcagggcgtggcgtccggcaccaacaacacgatccgcgaattcggggtggcggccggggtggcggctctctcgtcgatcttcagttcgctgggcggtttcagcagcttcgatgccttcatcgacggtacgcggccggcggtgctgaccggcgcggcggtgatcgcggtgggggcggtggtggggctctggctgccccgcaaggcctgaccaccggccggacccgacccccggtcccgcgtcacctcgtagcggacccaccggccggggcaaggccggcgtcggtgtaccgggctgcggcacgggccggttcctccttcacccgcttgacgtggcgccgctgctcgcgggcggtgtccgggtggagtcggcgatgtcgctgcgtccgcatcatgtcagtagccaccaaacgggtcgacccgccgctgaacgggcgcgaagtgtgtcggatggaaacaatcgggggtgaactgttgcccttccgcaacatgaatgcaacgatgaccttcaatcccgggctgagcggccgggcgagggcatcggcttcgtccggccgatccgaacccacctcgcgacgaccgcggcccggtgaccaccgcccgtccccccggcggagcgaagacagcgtgtgccggacctccgaccggcacacgctgtgcctttctccgggcacgaacggcgtaccgccgcatgccgggccgcggcccggcgatcagaagcggatctcagatgttgtgtttgaggtaggcgggttcccgccaccccagtatcgcctcggtcattcggatcgcgtcggaggccgcccggacgtcgtgcacccgcatgatccgtgcgccgcgcagcaggctgaagacgaccgtggccagcgttccggcgagtcgttcctgctgcgggcggtcgagggtttcgccgatgaagtccttgttgctcagggccgcgagcatcgggtagccgatggcggcgatctcgtcgaggcggcgggtgatctccagcgagtgaagggtgttcttgttcaggtcatggcccgggtcgatgatgatctgatccgggcgcacgccgcgggagagggccagcgcgaccttctgccggaggaagtcgccgacctcggcggtcacatcccgatatcgcggactggggtagagggtgcgcggcgcggcgaggctgtggcagatgaccagttgcgcgtccgtgccggcgaccgcgtcggccatcgcgggatcgcgcagcccggacgtgtcgttgacgacggcggcgccgtgccggatcacctcggcggccacctcggggcggaacgtgtcgaccgagacgacggccaggtcgcgggccgcctcgacgacgggcaggactcggtcgagctcctcggcggcggtgacctcggggccgggagcgaacgggacgccgccgatgtcgatccagtcggccccctcggcggccgcgtgacggaccgcctcggtggccttctccagggcgaaggtgcggcctttgtcgtggaacgagtccggcgtccggttcacgatcgccatcacgacggcctggcggctgaagtcgtacgtccggccgccgatcacccggatgctgctgaggtcactcacaaccggcgaccctacacagcgcggcaaccgacggcccggacaccgtgacctgtgagagtgtgattcggtgaggctgctgtccgaccgcagagtcggtatgaagatcatgttcgcggtgctcgtcgtcgccctgctcagcgtgaccgacggcctgttcgccatggacagtctcggcaccaccaacaacatggtgaaagccggctaccagaacagtctcgaactggagacgatcggcaacctgcgcagtgccgtcaaccggacctggctggcggcctccgacgacctgctcgccagcgacgccacggcccggcaggccgccaccggcgccccgaccgacgcgcagaaccaggtcgaccagtatgcgcagggatatcagggctatccgaccggcagcgacgagggcgccgcgttgcaggcgttccggatggcctgggcgtcgtacgccgacgtgctgagcggcacgctgctgccgctcgccgccgccggcgaccgggcgaagatcgacgccgtgcggacccggcagatcgtcccgttgatgaccgaggtgcgggggcagctcgccaggctgtccgacctgacggtggccgagaccgccgcgcaggagaccgccgccgagagccgctaccagggcaccaggtggcgggtgctgctgatgctgaccttcagcgccgggatcggggtggtcctcgccctcggggcgagccggatgatcgtacggccgctgtcgcggtgcgtgaccgtgctggaccggatccggaccggtgacctcaccgcccgcgccgaggtcaccggccgcgacgaggtcggccggatggccgacgccctcaaccacaccgcccaggcgatgagcgacatggtcggccgggtgcggaccagcgccgatgtcctcgcctccgccgccgaggagctgtccaccgtctccagcgagctgtccgtgtcggcggaggagacttccgcccaggtcggcacggtgtccgcatcggccggccgggtgtccgaaggggtgcaggcggtctccgccggggccgaggagatgggcgtgtcgatccgggagatcgcgaacagcgccaacgaggccgccggggtcgccgccgaggccgcccgtaccgccgagcacaccaacaccagcgtgtcccggctcggcgaggcgtccgcgcagatcagcacggtcgtcgcgctgatcacctcgatcgccgaacagaccaacctgctggccctcaacgcgaccatcgaggcggcccgggccggcgagatgggcaaggggttcgcggtggtcgccgccgaggtgaaggacctcgcccaggagaccgcccgggccacccaggagatcaccgcgcaggtcgccgcgatccagaccgaatccgacggggcggtacacgccatccggcagatcgccgcggtcatcgcgacgatcaacgactacgcgacgacgatcgcggcggccgtcgaggagcagaccgcgaccaccgccgagatcgcccgcagcgtcggtcaggccgcggaaggctcgtcggcgatcgccgggacgatcgccggtgtggcgcaggccgcccagcaggtcacctccggcgcgaccgagacccagcagaccgccgccgaactcgcccggaccgcggccgaactccaggccacggccgcgacctaccggacctgacgacgacatccgggcggcggcctcgtagagtcgccgggtttccgcggacaaggcacgccggagcgcttcgtggcgttcggggcggaccggtacgaccggctccgctacgccctcgacctgggctgagccgaggtcaggcggtggtgtcgcggatcagttcggtgacccagtcgacggcgacccgggcctggtccggggggctggagtgcagggcgtcgacgatcagccagatgcggtcggccagcagggcgtcaccgcccagctcggtgaccaggcggtcgaccacggcgcggctgtcggcgaggtaggcgcgggccagctgggccggctcgtcggtggcgcccgggaactcggtcagataattgcggaaggcgcagccccgccagcccggccggcgggtcgactcggcgatctcggcgaccagggcgatcagctgtccggccgggccgtgcgcccagcggagcgcctcggcggcggcctgctcgcgctcccggcgggacagtcgcagataggccgcggccagctgcgccttgctgggaaaatgccggtacagcaggttcttgccgcagccggcgacctcgacgacctgggccatgccgaccgcgcggacgccgtaccggtagaacagcccggcggccgcggtcagaatcgtgtcgcgggtgcccggaaccggcgtacgtgccatagtccccagattagcggactgatcggtccaaaccgacattcagccgtccattggacagttcgtaaatctggtctaccaaatcgagaccctccgcgcggtgcgcgaacaccagcaccgtccgcccggacgccgcgtccagcagatccgccatcagctcccgggcgcccgcctcatcgatcccctcggtcggctcatccaggatcagcagcgccggatcggccagcaacgcccgcgcggtggccagccggcgccgctgcccgcccgacatcgtgctgcccccggtccccagccaggtgtccagcccggccgccaaaccgtccagccacgggccgagaccgacccgccgcagcgcggcgacaacctctccgtcactcgcggccggtgcggcgagacgcagattttcccgtacgtcggaagcgaacacatgtccggtctcatcgctgacgaggacggcccggccgccgacgcgcacctcgccggaccgcggtcgcagcaggccgccgagcacggcggccagcgtcgacttcccggaaccggagcggccggtgacggccgccctggcgcctggccggaggtgcagcgaaaggccgtcgatcgtggggtcaccctgggggtcccaggcggcgaccagggcctcgatgatgacctcgccggacctcggccgggatgccggtggtggcgcggggtggccgggatcgaccggcgtggtgccgtggaccgccgcgctgtcggcgatgggcccggctccggcggcgatctcgtcagtgggtgtgtcggctccggtggcgggcgtttcgccggtggcgtcaggttccgctggctagctagctagtggcgtggcggcgggcgatggcggcttccggcagggcgaccagcggctcgcccagggcgatgacgcccagcagcaggaccgcggaccactccgcggaaaggccggcccggcccaggacgatggccgttccggcggcggcgaccgcccaccccaggtgggcgacggcggcggccaggccggcggtgcgggccgcccgggcctccagtacggccagggtgcggctacggttctccggcacgccggaacgggcggcgccggtgccgagttcctcgacgccgtcgaccgtctcgaccatcgcgtcccgcagggcggcccgagcggagccggtcgcggcctcctggcggtccgcctgccaccaggcgagcaacggggccaccacgccggtgatcacgatgccgagggcgagcacgccggcgatccgggtggcgagcacggcgggcgccaccccggccgcccgcgccgcgaggccggtcgatgcggcgtcgccggacaccgcgatggtggcggcggcatcccccgacatggcgatggtgagcgcggcggccccggcgaccgccaccgtcaccgcggcggtgaggatcgggaaccagccgcggagcagaccgtcgacccgggcgtccacgtcgtcgaccaggcgggtgaggagatcaccgcggcggtgcaaccgagggccggggacccgggggatcagctcggcgtagaccgcggcccgccgccgacccagccgggcgaacgccacgtcatgggcgaccagacgctccaggtagcggagcagggggcgggccaccgcgctgccgcggaccaggaccaccgccgcggacagggtcagcaccggaggcagggtggcggcccgcaccagcagccaggcggcggagccggtcagggtcagcccgccgaggaccgcggccgcacccagcgcgaccgcgacccagggccgccgccaccaactgccctccgcggcgatctcggcaggccggggtgcggacgcggggtgctctcgagaggcttccccgggagcgtcgcaggcggggctgtcggccggggtcgtcgtgatgccgggcggggcggtcaggtcgacgatgcggtccgcggcggcgaggagggcggggcggtgggcgaccaccaggacggcgcagcctcgtcgggcgaagtcctggaggtgggtgatgaccaggcgttcggcggcggggtcgaggtgggcggtgggttcgtcgagcagcagggtgaccaccgggccggggtgccggctcgcggcgggttcgccgcggcgcaggtgggtggcccggtgcaggagggcggccagggccaggcgctgacgttgaccggcggagatgccgcggccgtgctcgccgagcggggtctgcggagtgacctcggtgtccaggcctaccaggtgcagggcggagcggatctcgtcgtcggtggctccggccgggaacgcctcgccgatcgtccgggcgtgcggcagggccgggcgctgggacaggtggaaggtgcggcccaccgcgagggcgcccctgtcggcggggtgcaggccggccaggacccgcaggagggtgctcttgccggcgccggacgggccgcggagggcgacgaactcgccggcctggacggccagttcgggcagggagagcgcttcgccgcgggagccgggataggaggctcgcacgccggacgcgagcacaccccaccgcggggtcgccgcggccgacggtccgggtgcggtggcggcggggagtgcgggtgtcggggtggcagcggccgggagcgcgggtggaaggcccgcggtggcggcggggagtgcgggtgtcggggtggcagcggccgggagcgcgggtgaaaggcccgcggtggcggcagggaacgcgggtggcggggcggcgagatcgctgagcggagagggcgagggaacggggcaggagcggatgcggtgggtcagggccagccattcctggctgagggcggtgtccggcagagagccggtgcgagatgcggcgagcggcgccgcgggtggggtgaggatgtcggtgacgtcggtgatgaccgcggtggcgtcggtggcggcgtggtagcgggcggccatctcccgcagcgggcggtaggcctcgggggccagcaggatggcgagcagggccggggccagtggcatggagccgccggcgacccggatgccggcctggacggcgatcaggccgaccgagagggtgccgaccaggtccagggcggtggaggagaggaacgcgacccgcaggacccgcagggtggcgcggcggtgccggtcggtgaggtcggcgatgacggtggtctggcggtcggcccggccgtacatgcggagggtgccgagaccctggacgacgtcgaggaagtggccggccagccgggcgtcggcggcccagcgctgctcggcgcgggcctgggtggcccagccgatcagggcgccgaggatcgggaccagcgggagggtgagcagggcgatcaccgcggaggccgggtcggccaggaacatcacggtgagcacgaccgggggcagcgtcacgccgaggatcagggacggcaggtagccggcgaaccaggggcgcagggagtcgagcccggtgcccaggatggtggtgaggcgaccggcgccgaacgaggcgacccaggccgggccgcgccgcacgacggtgccgagcaggcggcggcggagctcgtcggtgaccttggcggcggtgcggcgggcggtgacctgttcggcccaggcgagcagggcacgggtggtgaaggcggcggcgagcagggcgacggcggtgccgcgggagccgccgaacagcagcgagtgtggccgggacggggcgatgagccgggtgagggccacggcgatggccagcgtcgcggcggcctgaccgatgccgatcagggactgcagggcgatgccggcgcgcgcggtgcgggcgtggcgcagcagcctcgggtcgatcgggccccgcggcgggcggcccgcggtgggcgggtggggcgaggcggacggtgctgacgacgtaccgtcaatcggggtggagcggccggaaccggcagcgaccgcgaccgaggagcgggccgcggtcatgacgggatccgctcgctggcgatgcggcggcggaacacccagtaggaccacgcctggtaggcgacgacgccgggcaggatgagcacgccggcgacggtgatcagtcgcagcgccgacgggccggcggcggcggattcgcgggtgagcgaccacagcggcgacagggtgctgcgcagcacgaccgcgccgtgggcggtgaagacggcgacgatcgcgccggtgaccgtgagcgcggtggtggtgaaggcgagcgcttcgcggccctggcgggcgagcataccggtgatgaagcagaggaccgcggcgaccagggtgagccgggaaccggtggcgaggccggcgagcagcagcaggacggtgccggcgttgccgccgtgccgggacagcgcgacggcgcggcggcggaccgggccggtggtgcgcagcgccaggaaggtggcgccgagcaggatcgtgccgagcagggcggcgagggcgccgaggccggccggcaccgagaacagcggggccaggctgcggctcaggccgtgcccggtgaccgcgccgtccgggccgagggccaggccgcgcacgaagatgccgagctgggcgccccagagcaggacgacgcccgccgacgaacccgccaggagcaggtcgcagcggtggcgccaggcgggggagtcgtgcttgccgcggaattccagcgcgacgccgcggaccgcgagcagcagcaggatgccgaccatcggcaggtagagggccgagagcaggaccgcgtaccaggacgggaaggcggcgaaggtgacgccgatcgcggcgaccagccacacctcgttgccgtcccagaacggcccgatggtgcggatcgcggcggcgcgttcgtggtcgtcccggccgatcatcggggcgagcaggccgacgccgaagtcgaagccttccaggacgaagtagagcacccaggccaggacgaggatcgcgaaccagaaagtgatcatggtgggctcctagtacgccagggctttgttctcggtgaccgagacttccggagtcatgggtttcgccgcgatgtggagcacgagccggtaccaggcgatcgccagcaggccgtagatcagcgtgaagccggccagggaggcgatcacctcggcgctggtcaggccgggggagatgccgtcggcgaccttggagatgccgaaggcgagccacggctgccgggccgtctcggtgaacacccagccgaacgtgttggccgcggcgggcagcagcggcgacagcagcaggatccgcttcacccaccccgggacctcgtcgtcggcgaagcgcaggaacccgggcagcagccggccggtccgcgccgacgaggcccagaggtagtacgccgcgagcgccatcccggccaccccggcgccgatcatcaggcggaacgtccagaacgccaccgggatcatcggtatgtagctgcccggtccgtactgcgccgcgtactgcgcctggagatcgtcgatgccctgcacggtgccgtcgaacgatccggtgcccaggaaggagagcagccgcgggatctccaccgtcaggaacggcttctcgtggccgagtctgcccagcgcgaagaccgagaacggcgccccggtggtggtcgagtagagcgcctcggcggccgccatcttcatcggctgcaccgacgtcatcaccttgcccagccggtcaccggtgatcgcggtcagcgctccgccggtcagcatcagccaggcgccgagccgggccagtgtccggaattcgtcatgaacggcgaggcgccacaccccgagggcgagcagcagtccgccgccggccatcgccgcgccggccatcgtgtgcgggaaggcggctagcaccacctcgttggtgagcagcccggtgaagctggtcaggcgggctcgtccggtgaccgggtcgagggcgtaggccaccgggttctgcatgaaggaattaccggcgaggatgatgtacgccgagagcagcgtcccgatcgcgacgaccacgatcgtggcggcgtggatccgccgggggagccgttcccatccgaaataccacagggccaggaacgtcgcctccaggaagaacgcgagcatcccctcgaccgccagggtcggcccgaagacgtcaccgtagaacttggcgaacgcgctccagccgagcccgaactggaactcctgcacgagtccggtgaccacccccaccgcgaaggtgacgatcaggagcttgccgacgaacttcgtcaggttccggtacttctcggtccgcgtccgcagccaggtcaggtgcagtcccgccgcggtcgccgacaggcagatcgacagcggcacgaacaggtagtggtagatcgtcaccaccgcgaactgcagccgggtcaggtcgagcacgtccatcgggtctccccctctacgactcttcgtagtagatactacgagacgtagtacgacacgctctagtaggatgggtcacatggcacttggcgatcttgaacgtgaggtcatgacccagctctgggacgcttccgagccgctcaccgtgcgacaggtgcacgagcggctcagcgccgaccgcgatctggcgtacacgaccgtgatgaccgtcctcgaccggctcgccaagaaggagctcgtcgtccagcagcgggccgaccgggcgtaccggtacgcgccggcgcagacccgcgaggagatgaccgccggcctgatgctcgacgcgctcagtgccactcccgatcgggacgccgcgctggcatacttcctgggccagctgccgcccggcgccatccaggccgccctgaacgcgacaccgaaagagacgtgaccgcactcctgctcggtgccctcgggttgaccctgtcactggtcgtcccgggcatcctggccggcgcccgatggcccgaccgcgccccggtcgccgccgtcctgctctggcaggccctcacgctgaccgcggtgctctgcgcgctcggcgtggtgctggccgcccccgaggagctgacccgggcggccggcgccggccacccgtgggcggtcgccgcgctggtgttctccctggcggtcgccgccaccatcgtcacccggctgttgatctcactgatccgggtcaccgcccgggcccgggcccgccgcgaacgccaccgcacgctggccgacctgctcgaccgggtggaacggcaccgcgaactgggcggtcccgaggtgcgggtgctcgacgcgccgttgccactggcctactgcgtgcccgggcgcgagccccgggtggtgctcagcgacgcggtgctgcgggtcctcgaccgtgcccaggtcgacgcggtgctcgcccacgagcaggcgcacctgcggcaccggcacgagctggtgatggagtcgttcaccgcgttctaccaggcggtgccggctccgctgcgctcccgggcgccgcttgacgccgtacacctgctgttggagatggtgtcggacgacgccgcgcggcgccggacaggcgcggcgcccctgcgtgccgcgctgtcccggctctccgacgcggttcccctcgcggaggaggccccggccgacccggcgggtgaatcccggcgccgccgcctcgaccggctggccggtcccgaggtcacctcgcggggcctgtcggtgctcgccgggctcgccgcggccagcctgatcgtgctacccacggtgatcctgatcgtgccctggctcggtcaggccctggatgcctggccattccggtcactgtgagtgctggagggtgtgcgagcggtttcgccgcgggcgcgcgcttcatttgcctcggtgatccgggtacggtggtccccggttcggcagccccccatcgtccatccggccgatctgacgaaccaccgcccaatcgcccgtaacggcgagccggggaaccaggtaagtggggtgtagccgttcgcggccgggcgttcttcccgcccgaacccgtcagctaacccggtcggcggctgaatggaagaaaggacaacgcacctacgtgaaacggataggcgcgcgtggcgtgctgcgcagtctgctctgcgccgccgtcgctgccggactcgttctcaccggacctgtcgttgcccacgccacgccctcgccgtccagcgtcgaggaccagatcgacaagcagtggaacgagctcgagcccgtcatcgaggacttcaacgacgtgcacgggaagctgatcaaactgcagaagcagcagaagcagctgaacgcgacgctcgacccgctgcagaagaaagtggacgtggccatgaaagacgtccgtggcctcgcctcggacgcctacatgcaaggcccgccgaccgctgtcgccgcgattctcagcggttcgccgaccagcctgaccgagaagctctcgctgctcgaacagctcgccgcgaaccgtcaggactcgatcagcgaggtggtgaaactccgcgacaagtacgccgccgacaaggcgaaggtggatgccctggcatccgagatctccgcccgcgacgccgatctgaaccagaagaagacggcgatcgagaaagagatcacctccctgcagaaactgcgcctgcaggcgtacgggaaaacggatgacgggccgttcaagacgggtccctgcccggtcgactacaccaacgacatcggtggccgggccgctcagaaggcgtgcgacctgatcggcaaaccctacgtattcggttccgagggcccgaacagctacgactgctcgggactgacgaaagcggcgtgggcgtcggtcggcgtgcacctggagcactacaccaaggatcagtggaccgagggccgcgcggtttcgcgaagcgaactgaaaccgggtgacctggtcttctactattccgacgtgcaccacgtgtcgatctacatcggcggtggaatggtcgtgcacgcaccgcacacgggcgaccacgtgcggatggcgacgatcgatcgcggtccgatcgccggctatcggcggccctcgggctgatccggtcagtcgggtcgtcaggccgcttccggtgcgccgggggcggcctttcgcgttccggcacatcggacacgggcataatcgcgtttcatgagcgacgcgctgatcgacagcctgaccgccgcggtccaggcccgccccgacgacctgccgctgcggctgcacctggccgagttgctggtgacggccggccggggcgccgaggcgatcgagcacgccgctcaggtcctcagccgtgatccggccaacgagacggcccgcggcttgatgacgtccgcgctcggcgggccggccccggctgccgccccggcctccggggtcgactggggcgcgatggagcagcagttcggcgatgtcgtcccgccccggttcgcccgggccggcgacgagcccgagccggtcaccggcgatgccgaccgggcgttcgacgtcgagcggtccaccgtgaccctggccgacgtgggcggcatggccgaggtgaagaagcggctcgaagtgtccttcctcggcccgctgcgcaacccgaaactccgcagcctgttcggcaagagcctgcgcggcggtctgctgctctacggtccgcccggctgcggcaagacattcctggcgcgggcggtggccggggagatgggcgcggcgttcctctcgctgtcgatcaccgacgtgctgaacatgtggatcggcagttcggagcggaacctgcacgacctgttcgagtcggcccgcgggcacgccccctgcgtgctgttcctcgacgagatcgacgcgctggggcacaagcgcagccagttgcactcctcggcgatgcgtaccgtggtcaaccagttgctcaccgagctggacggcgtgcagggcggcaacgagggcgtcttcgtgctggccgccaccaacgcgccgtgggacgtcgacgcggccctgcgccggccgggccggctcgaccggaccgtgctggtgctgccgccggacggtgcggcccgggccgcgatcgtcgagtaccacctgcgggaccggccggtcgccggggtggatctggcggcggtggccgcggccaccgagcacttctccggcgccgacctggcgcacctgtgtgagacggccgccgagtacgcgatgcgcgactcgatcgcgaccggcgagatccgcatgatcaaccagggggacatgctggccgcggcccgcgaggtgcgcccgtcgacggacgcgtggttcaccacggcgcgcaacgtcgcgatgttcgccaacgagagcggcgagtacgacgacctggccgcctacctgaggaaacggaagggccgctgagccttttatcactaacgggtcacggaaacttgcccgtctggcaagatcgccggatgctgtgcgtcatgccgcattcattcggcggcaagcttcgccgccccaccgctggtcaccggggtgttgccgggcaccgctagagtggcccgagtggtcacatcatgtggccatttttctcgatctaacggtttttgggtgtcagcgagccgggccggctcattgaggagcttgccgtgagcgtcgccgccccaccccgtgccgcccgctcccagtggatctccgcgctccgcgagctcggtctggtcgccgtgctgttcacgatctacaagatcggccggatcgccgccaccggccacgtcgtcgaggcctacgacaacgcgcgccgcgtctgggacctggaacgctggatgcacctgcccggcgagctcagccttcagcaccggttgctctcctggcactggctcgtcgaaacggcgaactgctattacgcgtacgtccatttccccgccaccgtggcctgcctgatctggttgtacgtgcgccgccccgcccactaccgctggacccgcaacgtgctcgccctgctcaccggcgcggcgctggtggtgcacttcggcttcccgctcgccccgccacggatgctgaccgccaccggcatgctcgatctgggccgcatctacggcccggcggtgtacggggcgccggaacacgaccagctctccaaccagtacgcggcgatgccctccctgcacgtcggctgggccgtcgtggtggccgtcgccctgatcgccgccaccggcagccgctggcgcggcctgtggctgctgcacccgatgatcacgctgctggtcgtcgtcggcaccggcaaccactactggctcgacgcggtcgccgcactcgccctgctcgccgcggcgtacctgttggtgcgaccccaattttccgcaaccttgaaaccgccggcgctcccggcgatggtccccctgccgcgcctcccgctcgaggagccggcgctgcgccgctagacaatctggccaggggcgggcgttgcgccgttgggtggtgctggccaggggcgggcgctgcgccgttgggcggtctgcgccggcggcgggggcgggccgctgaccggttcagtccgcggcgagcgggcgctgcgccgtcgggtggactgtgtcggagcggcatgagcccgcgtcgcgctggtggacgcttcccgtcgacaggagggccagtgttgagccgttgggcggtccatgccggcggcaagtggcgtcgtttcgtctctgtcggctgcaggagccggtcttgcgccgctgggcgcctcctggcaacgcggagcggcggtgtcgcgccgttaggcgctttcccaccagttcagcggattgccgtcgacgtcgtagacgttgccgtactcccagtgatcgccgcgcgggccggtccaggcgttgatcgccgcctccaccgcatcgaacccggccgcggccggcacggtgatcacgatgaaccgccggtccggcggcagctccacgatcccgcccaactcgtcgaaggcatcccggagcggcccgagatcatccccggcgggcggcgattccggcaccaccagcaggcagaggttgccgccgtgccgcaccacctcgaacccgccaccggcccggatccgaatctggtcgccggccgccagcccctccacgaaggcgggggtgccgagcaccatgcgcaggtcatcgtcgagcgggcgggtcagcaccgactcgtagacaatctggccacccgcgccgagcccggccaccagccggacatgctccgccatttcctccacggtcacgccgggcattctggggcatttcacccgccaccggtgatccaacgcgccgcagtctcgcatatcgttgccgacccgcgatcttcccggcccgccctgcctgcccgtcacgggtgatctttccggcccccctcctccgtcggccacctctcgccgccggctccctcttctgttggcccccctctcgccgccgcctccctccttcgccggcctccttctcgccgccggcctcgcctcccgccgccgacccgcctcccgaccgtgaccctcccgcgtcgccttccggtggcctctgcgccggccggccgggcacgccaggcccggccggcctcatctgatcagcagttgcgcagctcgggggactgattcagcagctgcccccgcggcgacacgaaccgctggtaccgctccccgcccaccgccgagaacgcgaacgccgccacccgatggcaattctggaacgccagcttcgccccgaaatgccgctccaacccaccgcggatcgcatcgctggccagcgctcgaagcagctgcccccgctcactctccgacggcggcggcacctcgtgatccgcgaattgctccccattcgcctgcagatcggtcatcaccgagctgaccacttcccacgcatacggcagcgacccccgcacgcaagccacaaactccgcatcggtcacctcgccccgctcggccctctccagcagctccgtcgaaacctcaagcgacatgccaaacccttcccgttgtacgtcgttgcccctccatcttgttggaaacgattttcattaccaagccaacacgccgtgcctcgtccgtccgcgcaccccgccccaccccatccgcctccatcccgcaccgaaccccgcacagcccgcactgaaccggcgcttccgcgcagcgtcgcccgatatcggtgatcgtcgtgccgcagccgagcccggcgcgtggtctcctcctgagttcggtgatcgctgcatggccctaggctgaaccgatgattttggactggccgcattgcgagaacgcccgcgacctaggcggtactcccaccatgaccggcggccagatccgccccggtgccctgatccgctcggacagccacagccgcctcactccggccgctgccgaagccgtccgctcccagccgatcgcccggatcctcgacctgcgctggtcccgcgagctggccgccgaccccagcccgttcttcgcggacccgttctaccgccacgtcccactgctgaacgacccgatgggttacgacccgccgctggacacctacgccccgatgctggaccacaacaccacccggatcgcgcgagcgttccacgagatcgccaccgcccctcccggcaccgtggtcatccattgccgcggcggccgcgaccgcaccggcgccctgaccgccctcctcctggccgtagccgaagtctccccggccgagatagccgccgatttcgcccgcaccccaggcacttcccccgaggcgatgcacaacacgctgacccacgccaccacccgctacggcggcgtccccaactacctgacccactgcggcgtagcccccaccgcactggccgccatccgccaccgcctgaccatcaccgcctaacccccagcatctgacccgcagcatctgacccgcctcggcctgattgcgcctcagctcgatcgcgcctcggcccgaccaccaccgcctgactctcagcacctgacgcgcctcggcctgatcgcgcctcggcccgaccgccaccgcctgccgatcagcatctgacgagcctcggcctgatcgcgcctcggtctgacagccgcgatctcatcaccgctgtataactgccgcctttcgccaacgcggaagctccaggccagcccggcagcggtgttccgtgtcgccggcacaatggctctccgacaccagccgcttccggctatgcccgcgtcgcacccagccgcctcccgctgcgcccgcaccagccgtgcccgtgccagccgtgcccgtgccggctgtggccctggcgcgcctggcgtgcctgtgccggtctcagccgcaccgcagagttcgtgcagggtgggtggtggtgctgtgcatcaggcggaggggcggctccactgcacggagaggccggtggccgcgcgttcggtccggatctccatcgccgagccgagcatggtggcgcggtcgaccaccagcgcggacccgtcgagcgcgtaggtcacccgctcggagaccagaaccggctccccgggcggccggcggagcaggccggcagcgggctcggcgagcaggccgggacggaccacctcagtagcgcggtggaccaggcgacccttggcgatcaacgccgcgtacagcgacagatcgctgagatcagcggacaccaactcggtgccgcgcacccacgacaactgatgcaccgccgggcggccgccgaccagccggacccgttccagccgcagcgcctcgtcctgaccgatcagcgcggcccagtcggggggcgtgccgatggactggtcgaggatctccgtggtcaccgtctgcccctggtcgcgcagatcctcggcgaacccgtgcaacgacgtgagctggtatttgatccgcgggtacacgaacgtcccccggcccggctcctgcgacagcagcccttcgtcctccaactgcttcagggcctgccgcagcgttgccagagtcaccccgtaccgcgcgctgagctccttctgcgggggcagcgcggacccggccggcaactcgccgtccttgatcttggtagtcaggtcatcggcgatcacctgatatttcggcgtgcgcgcgggcaacgggcatctcctggtcgacctggtcgagggcggcgcggtaggcggcgacctcggctcgcaggtcgtcgggtgaggcaccgtccagaaccctacgcatcagagcggcgccgatcaccaccccgtccccggcacgtgccgccgtggccgcctgcgccggcgtggagatgccgaaaccgatcagcacgggcaggtcggtcaccgccttgagccgggcggccagtggtgccgcggtcgcggccagcgtgtcacgctcgccggtggtgttcatgacgctcaccgcatagacgaaccctcggctgcgccggccgatctcggtgagccgatcctccggtgtgaccggcgcggccagcagcaccaggtcgatcccggccgccgccgcggccctctccagccggtcggcctcatccaccggcacatcgggcacgatcagcccggagaacccggcctccgccagccgccggcagaacgcctccggcccacccgtatccccgccgccgctcaacggcccatcgcctcggatggtggctcccgcgcccgaatctgtgggctcgccgcaccgggcggtcgcctggctgccgcgtacgggctggttcgctctgctggtgtcttttccaccttcgcgggtgggttcacctgcctggcgggtgggttcacctgcctgggggtcgccgcgaaagacgaggttggcgtatgtcatcgcgatcagtgggatgcggatgcggtgacgcgccgcggtcaggtcggacaggatcgacgcagccgttgctccccggcgcaacgcctggtcggaagctcgttggatggtggcgccgtcgaccatcgggtcggagaacggcagtccgatctcgaccgcgtcggcgccggcgtcctggaaggccagcaggtaatcgatccagtccggggtgatgccaccggtcaggtaaggattcagccgcttcatcggacctcaccggccagcgtcgccatgtccttgtctccccggccggagagggtgagcagcaccgtcgacccggcaggcagatcgggcgtgccggccgcgcgcagcacccaggccacggcatgcgccgactccagcgcgcagatgatcccctcgctgcgggccagccgccggaccgcggcgagcacctcgtcgtcggtgaccgtgcggtattccgcccggccggtcgtccccagatgcgcgtgctccggtccgacaccgggatagtccagcccggccgcgatcgattccgcctcgagcacctggccggccggatcctgcaggatcaaggagcggtagccgtgcaccacgccgggtgtcccgttggtcatcgcggcgccaccggccgcctccaccccgaccagccgcgccggagtgtccacgaacccggcgaaggtgccggccgcgttggacccgccgcccacgcaggccacgaccacgtcgggaacgacgggggtctgcgcccgggcctcctcgccgatcacccgctgcagctcgcggaccagccacggatagggatgcgggccggccaccgatccgaggcagaaatgtgcctcgtcgactgcggcgacccaggcgcgcatcgcctcgttcgtcgcgtccttcagcgtgcggctgccgctggtcaccgggatcacctcggcgccgagcagctccatccggaagacgttgagccgctgacggtcgatgtcacgctcacccatgtagacggtggcgcgcatgccgaacagggcggcggcggtggccgtggcgacgccgtgctggccggcgccggtctcggcgatcagccgggtcttgcccatccgctgcgccagcactgcctggccgagcacgttgttgattttgtgggagccggtgtgagccaggtcctcccgcttgagcagcagggtcacgccgagctcggcggagaggttggcggcgggggtgagggctgtggggcgccccgcatattccgagcggagccgggcgagccgctcgtggaatgacgggtcggcccaggcctcgcgaaacgccgctgccagcgcggcgcaggccgggaccagtgactcgggcacataacgcccgccgaactcgccgaagcggccggtggccgtcggtgcctccatcgccgcggccgggtgaggccttgctgtctcgatgtgtgctgtctccagcatctgcgtcggcgctgacatctcacgctccaaaagttatagaactctgccgcccaagcatgccatgatgggcggcagagttctagaactatttcggagggggtcaggccaccttgtacagcgcctccggcgtcaccagcccggccagcacccggccgtcatcggtgaccagcacactgaacagcgagccgctcagcagccggcccttgccccacgagccgctcacctccggcagcacactcagcagtgcctgcgcctgctgggcgtcctcaccggtgcccttgccggccttcgtcagctcggacagcgtgcccccgggcagcttggccgagacgatcgaggtccagcccttgccgatcaccttcggcccgtccttctgcgacgagacggaggggaccgggtgcgggagacccttcttggccgcgtcacccttggccgcgccggccttggcggcgtccgacggggttccggcctcgtcgatcttcgcgttcggcggcgggttgaaggtgaactgctccgcgtccggcacgctgaagctgatggagtcgaaagcgacccggacagccggcttcgccgcacccttggcatacacctcgacccgcagcgggacgtgctgctcggcgtcgatcgccagccgcacctgccccaccagcgactcggtgtctcgcgggctcagcaccagctcgtacgcgtcccgcccggccaccttggccgcgccggtggtctcgaccttggtcgacgggtcgatcgcggcgagagccgcgtccgccgcctgctgcggggtcgacggcagtgcgctgggcagcgaccgcggcgaccccttgccggcgtccttcggcagcttcaggtgcttgcccgtgttgtccgagctgctccactgccagacgtccgacccgttacggatcacgtcggtctcaccctgcgtcccgagcagggcgaaccgcaccttgtcctcacccgcgtaccacacgcgggcggtgttgctgccggcgatcagactggtcaggccaccggtgccgccggccgaggcgccgaacttgctggccagcccggcgacgccgggcagacccagatcggtgctctcgaccacggtgccggagagaccggccgggttggcgccctgcagatccaccagcaactgggccgcgctgcggtccggcagcgaggggccggcattcgccacgatcgtgccggctgccgcgccgcccccgatgacgacgaccgcggtggcccccggtagcagccagcgcagtgccggcctcgacttccacacggacacgatgtccacctcccgttggtatgcagcaatcgtgcttcggcaccgctgtgacaaggctgagagcgacccgtaggggccaggcttaggggaccacagggccgctagccatgtgcagtgacataggtggcgttcgagggagatgagcaggcagcaacggcaggtgcgaatgaacgacggcgtcaggcgacaagaatttgggtgcactagctataggtgcgtgcggtctgaggatcggggtgccggggtctagctagctagagtgccggagtgccggagtgccgggtgtcagaggtctccatgcgatcagggcgtgcggtggggcctggagtgctgtgacgggactgagagccggtaaccaccggagggatcgacatgacaaggtggcatcgtgcggttgctggtggtggaggacgaggaacggctggctgctgcgctgcgtcgtggcttgcaggccgaggggttcgcggtcgatgtggcccacgacgggcaggacgggctggagatggcccgccacggcggatatgacgcgatgattctcgatgtcatgctgccgcggctctccgggtatcgcgtcgtgcgacagttgcgggccgagcggcactggttgccggtgctgatgctctccgcgaaagacggtgagtatgaccaggccgatggtctggattgcggcgccgacgactatctgaccaagcctttttcgtacgtcgtcctcctcgcccggctgcgcgcgttgctgcgccgtggcacgcaggctcggcccgtggttctgacctgtggtgatgtcgagctggatccggcggagaagcgggtgctggtcaccggcaccgaggtcaccctgaccacccgcgagttcgccctgctggagtatctgatccgtcgtccgggcgaggtcgtctcgaagaccgaactgcttgatcatgtctgggatgccgctctggagaccgcgcccaacgctgtggaggtctacatcggctacctgcgtcgcaagatcggccgggaccgtctggaaacggtccgcggttccggctaccgcctcgtcgccgcgtccggcgccctcaccgagtagcagccatgacaccgaggccccctcccgcgtcgtccggtggcgtggtggcgccgggccgcggtgatgccgccgttcgcgcacggctcggaagtgggcggctcgccgtggtggtgccagctgacggaagggcgttgacggtgaggtcggtgcccgcgcttgagccggtgagcgggtgggggttgcgggccggtggggtcggtgccggcgcttgagctatcgaactggtgggggcttgtaaccagtggggtcggcgcccccgcttgagctggtgagctggtgagctggtgagctggtgagctggtgagctggtgagctggtgagctggtgagccggtgagccggtgagccggtggggtcggcggctgggcgtggggtcgtgaggcgggcggggagggcgtggggcagtgacggtggtgggggagacgcgcggggcggtggggtgatgcggcggcggcttcgggagctgagtctgcgggctcggctgttgctgatctcggtggcggcgctggggttcgggctggcggccggcggggtggtgctggtgacagtgctgaccttcgcgcaggggcgggcggtgcactcgcaggcgatggacacggcgcgaggggtggcgagcctggtcgatcaggggcagctgcccagtcggatcgaggtttcgccggagacgaaagttcaggtcatcgacgaatcggggcgggtgcggtcggtgtcggccacggctgaccggctggtgcccttcctgtacgaggatgagctgcgggatctgcccgacggggagggacggtcgatccccggggagcggatcgggttcgagggcgaggcccgggtggtcaaactgaccgcgggtccggccacccagccgctgcgaatcctggtggcgcggtcgaccagcgagctgacgcagagcgtgcatctgctgcgggtcacgctgctggtggcgttcccgctgctggtggccttgctggcggccgggctgtggcgggcgctcggggcggcgctgcggccggtggacgcgctgcgcgccggagctgaagagatcaccggggggacccgggccggacggctgccggtgccggactcgcacgacgaggtcgggcggctggcgatcacgctcaacgacatgctgcatcggctggacacggcgcgggcgcggcagcgggcgttcgtggcggacgcggcgcacgagttgcgcagcccgctcaccaacatgcgaaccgagctggaggtggcgcagcggctgccggacgacaccgactgggcggccttcaccgacgatctgctcgtcgatgtgcaacgactgtcccggctggtggacgacctgctgttgctggcgcgggccgatgacggggtggggcgggcggcggtcgctcgccggctcgaggaggtcgacctcgggcagttggtcgatgaggtggcgtcgcggtatccgggtgtggaggtcgtggcgtccgacgagccgctgccgatggtggccgagccggacgggctggcccgggtggtggcgaatctgatcgacaacgcctgccggcacaaacgggaccgggtgacggtgcgtacggcagcgtccgggacggacctgctggtcgtggtcaccgacgacgggccggggattccggcggaagaccgggaacgggtgttccaccggttcacccggctcgacgatgcacgggcgcgggatgccggcgggtccgggctggggttggcgatcgtccgggaactggtgcgcaggcacggcggttcggtgacgctcggcgacgctgagccgggactgcgggtcgaggttcgcctaccggccgacaaacagcagacgcccgtatccgcttcaaccccggcgagcccgaagtgatggcccgcccggaggcggggtgagctggccggcgggaccccggaggcggggtgagctgggccggcgggaccccggaggcggggtgagctgggccggcgggaccccggaggcggggtgagctgggccggcgggaccccggaggtgggggcgggggcgcggacgggtgagaatcgggggaaaagctgtggagggtgggaactttccgcaacatcgggccgaccaaggagcgtgcccggcagcgggcgatgaatcgacggaaggttccttcaacaatgtcgctgctcaagcgttccgcagtggtggccgccgcggccggattgctgaccctggcgctggccggaccggccgccgcgcatgtgacggtcaacccgaacacggcgaccgcgggcggatacacgaaggtcgccttccgcgtgccgaacgagtcggacagcgcgtcgaccaccaagctcgaggtgaacctgccggccgaccagccgatcgcctcggtgtcggtgaagccgctgccgggatggacggcgaccgcggtgaagacgaagctggccacgccgatcaaatcgcacgacaccgagatcaccgaggcggtttccaagatcacctggacggcggccaaggggtcggagatccagccggggcagttccaggagttcgacgtgtcgatgggggcgttgccgcaatcggggcagctggtgttcaaggcgctgcagacgtactccgacggcaccgtggtccgctggatcgacgagcccaccgcggacgggtccgagccggacagcccggcgccggtgctcaagatcgtgccggctgccgccgcgagcgcctcgccggccgccgctgccgccgccgccccggcgaaagccgacgactccggcgattcgggcagcggtacgggctggggtcttgccggactcgtcgccgggttggtggcgctggtgctggccggactcgcgtacgcgaaagcaagccgtaagccggagaccgccggaaccggcaaggccgccgcaagctgaggattcgccggggttgcgggtccgccgggaggccggacccgcaacacgcgtcgatcgggtcgccgtctgctggaccattcccgatggtgacgccgggtagaaacggatccatcggcagtggggtgggaaggtctgtcccggaaccggggtgagctgcgctaggctgccgcggaagatcaacgacggcctgctggagaacacatgacggtccgcatctggcagggcatggcgggcaagtcccgtctttggcacgggctgctggcgttcatcgtcctggcgtcgctgatcacgcagatcgtcctgacggcgacggattcagcgccgcatgccgggcccgcggtgcacgagaccgtggtgacaagattcgtccggctttttagctacttcacgattcagagcaacctgctggtgctgatcgcgaccctggccctgctgcgggatccgaaccgggatgggcgggtctggcgggtcatccggctcgacgcgctgctcggcatcgtgatcaccggaatcgtgtacagcacgatcctggccgggcaggtggcgctgcacggggccgcctacctggccaatctgggtttccactacatcgccccgtgggcggccctgctcggttggctgctcttcggcccgcggccgcggatcgacgcgcggaccatggcctgggcggcgctctggccgacgctgtggatcgggtacacactggcgcacggcgccgccaccgactggtatccgtatccgttcgccgatgtgaacagcctcggttatcccagggtgctggccaacctggcagctgtcgtgctcgttgccgcggtgctggccgccctgctgcgtctgctcgatacgcgtctcccgtacagggtggcggctgctcctgaggcggcggctcctgtcctgccgcttccccgttccggcacggagcccgtcgctcaccgcgataggtgacgctgccgcaggtccggtcctcggcaccgtccatgcttacttcctgcttgagcatcgttcaagcggccggcgatggaagtcgtcttgagtcggcccgcgcaggtgagcgggtccgggcggatttgccgttgctggttcggcaggactcaataatctgccgaaactggtgggtgtcgtcaacccagaacgggcgactgctcaactagctcggacgcctctgttcgctcttgtggatggggcctcacccggcccgcgccgataaggacgaccctctcgtccgaccacgtccggggtgccgtcaccccggccgggtcctcgacggtcaagcgggcaagacgtaaggccgatggagccggctgtgacagcacaagctctcgtcccatatccagctgatgaatggccagctcggtggcccaggtggcaaggaaatcaccggtcgagaggacatgcccctgaaatcgcaccgcggcagactcgagccgggaagtggcggcgcgcacgccttccaccgtcggcagcatgtgccgcgtcgaatgcgctttgagttgtaggccttgacgtggcaatcgacaaaagccaacagcaacgccggtcaatgtgcggatggcgcgagcggcgtgaacgcctggggcggattcagtccgccatccaatagtgcagggcgaagccccacggggagaacgtcagcacggtcacggccccccacgcccagacccaggctctcgcgtgcaccgacgggccacggtctctcgccgacatcgcgactgaccagccgaccagaggcagcgggaagaagaggaggaatcccacgaggaagtgggccgtgacgaaccacgcgtacagcgggcaccaccacggcgccgcctcgaccgaggggaaggggatcgagtccttcgggtctccgagccgtgccaggctcggtgcgaacaacgccacgtagtcgccggtgcggagcaccgcacacaacagtgacggcagggcgccgaacaggtgtacccccagcagaatctgcaggaggcgggtggtcatccggccaggatgccgccgcccgtccacctccggccgagtttgtcgttcgagatgcgctcgtgacatggccggcaaggtaccaggcctctaccaggcatttgtcgccctcgtgaggtcggctgaggcggaacacccgttgcggcgtcggcggccgatccaacaacttttagaacgactggagttcttcgggccgacatgccggccgtcctcggccgcaccggcaccgccgcctacctgctcggagccgtcagcaatgtccaggccagggaccgcactcacaactctcggatattttctcgaaactctcgggatcaaaggcctccgtctgagctggttaagagcccagctcagacagctttctcggcgctgccgacattgatacttccggaaattttccggtagatattgtttcggcattgttgccgtgccagcatgggctgcatcgaagcccatcgctctggctccgattccgcacctcgtcgaatccccgcaccggacggcggcccgcccgccctccggcgatgcccggcggccggagtcggagctgacaaggagatcaccgtggcaaacgaatccccccgccggcgatccctgccggtccgggccctgctcgccggcaccgtcgccgccgtcggcgcgttcaccgccctgatggtgacgccggatgccaacgccgccgccggcaccctgggtgccgccgccgcccagtccggccgctatttcggcaccgcgatcgccgcgggccggctcggcgatgccacctacaccacgatcgccgggcgtgagttcaccatggtcacgccggagaacgagatgaagccggacgccaccgaaccgcagcgcggccagttcactttcagctccggggaccagatctacaactgggccacccagcgcggcatgaaggtccgcggtcacacgctggcctggcattcgcagcagccgggctggatgcagagcctcaacggcagcggcctgcgccaggccatgatcgaccacatcaacggcgtgatggcccactacaagggcaaactcgcctactgggacgtggtcaacgaggcgtacaacgaggatggcagccgtcggcagtcgaatctgcagggcaccggcaacgactggatcgaggtggcgttccgcacggcgcgggccgccgacccgtcggtcaagctctgctacaacgattacaacatcgagaattggtcgtacgcgaagacccagggcgtctacaacatgatccgggacttcaagtcgcgcggcgtcccgatcgactgcgtcggcctgcagacccacttcaccgggggcagctcgctgccgggcaacttcccgaccacgctgtcgagcttcgcggcgctgggtgtcgacgtcgcgctgaccgaggtcgacgtcaccaacgcatccacctcgcagtacgccgggctcactcaggcctgcgtcaacgtgccccgctgtgtcggcatcacggtgtggggcgtgcgggacagcgattcgtggcggtccagcgagagccccctgctgttcgacggtggcggcaccaagaaggcggcgtacacctcggtgctcaacgccctgaacgcggccggtccggtcacctcgtcgccgaccccgggcggcggctccggttcgccgtcatcgtcgccgtccaccccgccggccggcaccgggcggatcgtcggcgcccagtccggccggtgcatcgacgtgccgaacgcgtcgcagaacaacggcacccgggtgcagctctacgactgcaacggccagaccaaccaggcgtggacgctcacctccggcaagcagctgaccgtgtacggcaaccgctgcctggacgccgcggggtcgggcaacggcgcggccgtgcagatctacagctgcaacgggcaggccaaccagcagtggaacgtcaacgccaacgggaccatcaccggcgtgcagtcggggcgctgcctcgacgtctggggcaccggtaacggccagcaggtgcagatctacgactgcagtgggcaggccaaccagcggttcaccctgagctgatcaggggtcggccggggcgggggagccgagcggcgtgtcgtcgaggctctcccgcaggtcgaccagggagtcgaagacgcgtacggcgcccgcgtcgtgaagctcttgaaccgagaatccgccggtgcgcacggcgatggtcggcacctcgagtttgcgggccgcgacgcagtcccaggtggagtcgccgatcatcacgccggacacgccgtcgacccggtgcagtgcggttgccaccagatccggctcgggtttgctgttctccacgtcgtcggcagtggtccaggcgtccgcgaacgggcggccgccgaccaggtcgaggaagtgttcgacgtgctgcttcttaccggagctggcgagcacgaggcggaacccgcgggacttgacctcctcgatcagctcgcgggctccctcgaacggccggacctcgtcgatcagccggtcgaactcctcgctccagacctcgcggagcgcgtcgccgtggcgccgctcgacgtcgtcgccggccaccgccttgacgagttgatcgccacccatgccgatggcgcggtggatgcgccagatcggcagggtgatttcgtagcgccggaaggaccggtaccaggccagggcgtgctggtagttggtgtcgacgagggtgccgtcgacgtcgaagatcgcggtgtcggccatcctccgcctgtacccaccgcgacccggctcactccccgcaggcgttgccgttgagggtgaacccggtgggcgccgcggtgttcccggtgtgcccggcctggaaaccgatggtgaccgacccgttgaccgggatcgcggcgtggtaaccggcgttccgtgcggtcaccgacccgctggccggcgagtaggtcgcgttccacccggagctgatggtctggccggcggccagcgtgaagcccagcgcccacccgtcgacggcggcgctcccggtgtcggtgatggtgaggttcgcggtcagcccggtgcgccaggcgctgatcgaggtgctcacccggcaggccgtgccggccggtgcgggtgacgacggtgacgggggcggggaggtggtggcgccgtccaggcctcggtgcgggtggcttcgggcagcacgacgatgtatccgtggcggtccgccgcggtgaggtagtcccggccgttcccgccggccggttcagggcagggtgcaggcgatcgccggggtgatggcggggctgccggaggcgatcaggccgaaggtggcggcggcgccgggatcgagcatgccgttgtacgtggcgttgacgaccgtgacggcgttgccgctgacgctcagcgagccgctccacacctggctgatcgattgtccggcgggcagcgtccagccgacccgccatccgctggtcggcgtggtgccggtgttggtgacggtgacctccgcctggaagccgcccggccagctgttgacgacccggtaggtgacggcgcagccgcccggctggccaccgggcgtcccggacggcgtgaccgacggcgacaccggcggggtggtgctcggcagctgggcgaagaacttcgcgatctccgcgccggtccaggtgcgcgcgccgtccgtggcggtcgtcccgtccaccggctccggggtgtggtcgccgtcgaaggcggcccactcgaccgggtgaccggtccggcatccggtgtaggcggtcaccacatgggtgaggctgccgcgggccggttccggcgggttctgcgcggtgcagccgttggcccgcacgaaactgtcccgcaggccgcgcccgagggagatgtccaggacgctgtcgtggatgccgtggatgccgaggtacgcgaccggctgaccgatgccggagcagccgctgaggttggcgccggagagcaccgccaccgcgcggaagaccgcggggcgggcgcacgccacggcgtagctcatcgcaccgccgtaactccagcccagcgcgaacacctgggaggtgtcgacgcacaggtcgccctcgatcagtgcggtgagggcatcgaccagggccaggtcgcggccgccggggttggcccagccgttgtcgatgccctgcggcgcgaccaggatggtggtggcgccggcgagtcgctgctggccgtagtaggcccaggtcgcgccggccgggccgccggtcgccacgtcggccgcggtgccgttgagccagtggaaggcgaacatcagccggtacgggtggttgcggtcgtagccgtccggcacccgcaggatgtaggtgcggttctggccgccgctggagatggtgcgggtgccgctcgtcagggtcggtgccttgccgcatccggcgaccgccgccgtggcgggcacgccggtgccgaacagtccggtgagcgtcgcggtggccagggccagcgcgcagagaatcgctgtcacggtgcgtcgggtcatctcaggttcccctttccggcgccggtcgggggtgaccggcgccgggtgtcgatcggtcaggcggcggcgcaggtgggtgtcgcggtcgggccggtgccggtgccctggaagccgaactcggtggtgccaccggcggccagctgcccgttgtagctggcgttgcggaagctgaccgtgccggtgctgccgccggcggtggcactccaggtgctggtcacggcgctgccggcgggcagggcgacgccgacgttccagccggtgatcggggcggacccggcggtgaccctgatggtcgcgacgaagccgccgttccacgagttgagcgacaccgacgcgctgcaggccccggacggctgcggcggagtgctgacgctggtgctgggcgacggtgcggacggcgaggtggtggtcccgccggcgttgagggcgttcagcaccgaggtgtatgccgccttcttgttcccggagccgtcgaacagcagcgggttctcgccgctgcgccacgagtcggtgtcccggatgccccagacggtgatgccggcgcaccgcgacaccgccatgcaggccctggtcacgctcgcgtagacgttcgcctggttgccgccctgcgccacgtccagctcggtgatctggacgtcgacgcccaggtcggcgaagcgctgcaggttcgcctggtagtcgccggggatcccggtgcccaggtgcgactggaagccgacgcagtcgatcggcacgccgcgggacttgaagtcgcggaccatggtgtagacgccggtcgacttcgcgttgatcccgtcggtgttgtagtcgttgtagcagagcttcgcgcccgggtcggcggcccgcgcggcccggaaggcggcctcgatccagtcgttgccggtgcgctgcaggttggagtcgcggcgggccccgctgccgccgtcggcgaacgcctcgttcaccacgtcccaggcgtagatcttgcctttgtagtgcgtggcgacctgggtgacgtggttgatcgccgcactgcgcagcgcgctgccggacagtgcctgcgcccagccgggctgctggttgtgccagagcagggcgtgcccgcggacccgggacccgttggtcaggccctggttgagaatgcggtcgccgttggtgaaggtgaaccggccctgggacggttcggtggcgtcccacttcatctcgttctccggggtgaccgcattgaactcgcgggtcaggatcccggtgtaggtggtgtcgccgagccggccggcagcgatcgcggcgccgaagtaccggccggtctgcgcggccgaggcgccgagcgtggtcgccgcctcggcggtgccgatcaccgcgacgctcgcggccacgacgactcccgcggcggccgaggccagcagcagggagcgggttctgcggagcagggacatggcgggggcccttccgtgggagcgcttccatcaatgaacggcaatgttgccaatacatttcgcggcaaggcaagatccgaccatcgtggtggcgccggcataacgatttccgatccggaaattgatgaccgcaaaagtgttatctccggtgccgtgccgtggtcgtgcgacgagatcggctttttcggatggtgcaccaagctgttcgtctccggtgccacctgggcggacgccggtcgtccgggagcgtgccgcgagagagcggcaaaagacctcttgaatgtctggaaacatcctgacaaccttcggaaacaggtctgttagcgctcccatccccttccggtgttgcgttctagtaccgtccgagcagcggaaacaccggtgtgagcgataacaggtccaccatccctcgaaaggaccccgccatgccccgaagcagcctgcctggacgacgacggtggttccggacagcgatcctcgccgtcctctgcgtcgccggcgtgatcgccctgcccggctccgcggcgcaggcactcgacaacggggtggcgcgcaccccgccgatgggctggaacagctggaacaccttcggctgcaacatcagcgaatcgctgatccggcagatggccgacgcggtggtcagcagcggcatgcgcgacctcggctaccagtacgtggtggtggacgactgctggttcaacccgaaccgggactcggccggcaacctgcagggcgaccccacgcggttccccagcgggatgaaggcgctcggcgactacctgcacgccaagggcctcaagttcggcctctacgaggtgccgctggacaagacctgcgcccagtacttcaacagctatcccggggcgaccggcagccagggacacgaggcgcaggacgcgcggcagttcgccgcgtggggggtcgattacctcaagtacgactggtgctcgccgaccggcacgatcaacgaccaggtcaccacgttcgcgaagatgcgcgacgcgctggcggccaccgggcggccgatcgtctacagcatcaacccgaacagcgtgcacgccaagaccggcccgcagcgcaactggggagacgtcgccaacatgtggcgcaccaccgaggacatcagcgccgcctgggacaccgggcagaccaacggctacccgatgggcgtcaagaacatcgtggacgtcaccgtgccgctggccggatacgcccgccccgggcagttcaacgacccggacatgatggaggtcgggcgcagcgggctgaccgacaccgagcagcgcagccacttcgcgctctggacgatgctggccgcgccgctgatcgccggcaacgacctgcggtcgatgagcacggccacccagaccatcctgaagaacccgcggctgatcgcgatcgaccaggattcgctcggcctgcaggccacccaggtcagcaacgacggcacccgccgcgtactggcgaagaagttgtccaacggtgacgtcgcggtggctctctacaaccagggtggcgccaccacgaccgtgtcgacgaccgccgcggcgatcggcaagtccggcggttccctcaccctgcaggacgcctggaccggcggcacgacgaccagcaccggcgcgatcagcgcaagtgtccccgcccacggcacggtggtctaccgggtcagcggcgggggaacgggcacgccgccggccggcgcgacgctggtcagcgcctcctcgggacggtgcctcgacgtgccgaacagcgccacggccaacggtacccagccggccgtctgggactgcaacggcggcgccaaccagcagtggaccgccggcggggcgaccctgcagtcgctcggcaagtgcctggacgcgccgaccggcgccaccgccggcagcaaggtccagctgtgggactgcaacggcggcaccaaccagcagtggaccctcaacgccgacggcacgatccgcggcaccgcctccggcctgtgcctggacgtcgaccacaacctgaccgcgaacggcaccccggtcctgctctggacctgcaccgccgccgtcaaccagcgctggagccgtggctgatgccgaaacgatcctgggcggccgcccttctgatcctggcgagcctggccgtcccgtccgccgcgcacgccgacaacccgatcgtgcagaccgtgtacaccgccgatccggcgccgatggtctacaacgggcgcgtctacctctacaccggtcacgacgaggacaactcgacgtactacacgatgaaggactggcggctgttctcgtccgccgacatggtcaactggaccgatcacggttcgccgatgagcctggccaccttcagctgggccggtgcgaacgcctgggccggtcaggtggtcccgcgtaacggcaagttctactggtacgtgccggtcaccgaccgggcgaccgggcggatggcgatcggggtcggggtggcgaacagccccaccgggccgttcaccgacgccctcgggcatccgctcgccgagaacggtgagatcgacccgacggtcttcatcgacgactccggccaggcctacctctactggggcaaccccaacctgtggtacgtgcggctcaaccccgacatgatcagctacaccggggggatccagcagatcccgctgaccacggccgggttcggcacccggaccggcagcaccaaccggccgacgttgtacgaggagggcccctgggtctacaagcgcaacggaacctactacaacgtcttcgccgcgaagtgctgctcggagttcatcggttactccaccgcgcccggaccgaccgggccgtggacctatcgcggcacggtgatgccgacccagggtggcagcttcaccaaccatccgggcgtcatcgacttcaacggcaattcgtacttcttctaccacaacggcgcgctgcccggcggcggcggatacacccgctcggtcgcggtggagaggttcagctaccacgccgacggcagcatcccgacgatcaccatgaccacgggcggggcgccgcaggtcgggacgctcaacccgtacgtccggcaggaggccgagaccatcgcctggagttccggcgtggagaccgaggcgaccagcggcggccggaacgtcggatacctcgagaacggcgactacatcaaggtgaagggcgtcgccttcggtacgggggccacctcgttctcggcccgggtcgcctcggccacctcggggggccgtctcgaactgcggctgggcagcgccaccggcgcggtggtgggcacctgcacggtgccggggaccggcggctggcagacctggaccacggtcacctgtccggtcagcggggcgaccggcaccccggacctgtatctgcggttcaccggcggcagcggctatctgttcaacgtcgactggtggcagttcgcgggggcggggagcgcgcgatgaggatccgcccgctcgcggccgccgacatccggcccggctcggggcggaccgcgacgttctcgtacagcaccaccggcagcacgttcaccccgctgggcccggcgttcaccctgaacaacgcccggcagttcttcatgggtcaccggttcggcctcttcgactacgccacccaggcgctgggcggcgcggtcaccgccaaccggttcgacctgaccacgccctgaggcgcggccaccgcatccacatcaaggagcgactcatgaccccgttcccgatcagccgccgcggcctgctgcaggcggccggcgccggcgcggtggccgccggcctcgggccgatctcccgggccgacgctgcggcggttgcgccggcccgggccgacctcggtgtctcggccttcccgttcgacctcggacaggtgcggctgaccaccggacgattcctggacaaccagacgcgcacgctgaactacctgcgcttcgtcgacgccgaccggctgctctacaacttccgggccaaccacggcaggagcaccggcggcgccgcggccaacggcggctgggacgcgcccgacttcccgttccgcacccacgtgcagggtcacttcctgaccgcgtgggcgcaggcctgggccgcgctgggcgacaccacctgccgggaccgggcgaactacatggtcgccgagctggccaagtgtcaggcggccaacggctacctgtccggtttcccggagtccgacttcaccgccctggaggcgggcaccctcagcaacggcaacgtcccctactactgcgtgcacaagacgctcgccgggctgctcgacgtctggcggctgatcggcggcacccaggcccgcgacgtgctgctgcggctcgcgggatgggtcgacacccggaccgcgcggctgaccaccagccagatgcaggccatgctgggtaccgagttcggtggcatgaacgaggtgctggccgacatctaccagcagaccggcgacggccgctggctcgccaccgcccagcggttcgaccacgccgccgtcttcaccccgctggccgcgggcgccgaccagctcaacgggctgcacgccaacacccaggtgcccaagtgggtgggtgccgtccgggagtacaaggccaccggcaccacccgctaccgcgacatcgggctcaacgcctggaacatcaccacgggcgcgcacacctacgcgatcggcggcaacagccaggccgagcatttccgtgccccgaacgcgatcgccggctacctcaccaacgacacctgcgagcactgcaactcctacaacatgctcaagctgacccgggaactgtggctgaccgacccggaccgggcggcgtacttcgacttctacgagcgggcgctgctcaaccacctgatcggcgcgcagaacccggccgacagccatggccacatcacctacttcaccccgctacggcccggcgggcggcgcggggtgggaccggcctggggcggcggcacctggtccaccgactacgccagcttctggtgctgccagggcaccggggtcgagaccaacaccaagctgatggagtcgatctacttcttcagcgggaccaccctgacggtcaacctgttcaccccctcggtgctgtcctgggccgagcggggcatcaccgtcacgcaggccaccgcgtacccggtcagcgacaccaccacgctgaccgtgtccggcacgccgagtgggacctggagcatccgggtgcgcattccgggctggacgaccggcgccaccctcgcggtcaacggcgtggcgcagggcgtcggcgccaccccgggcggctatgccaccgtcacccgcgcctgggcggcgggcgacgtgctgaccgtccggctcccgatgcgagtgatcatgcagccggctgccgacaaccccgcggtgcaggcgatcacgtacggcccggtggtgctctgcggcaactacggcggcaccacgctgtcggcgcatccgtcgctgaacgtgtcgtccatcgcccggaccgggagcggcagcctggccttcacggctaccgcgaacggcgccaccgtgtcgctcggcccgttccccgacgcgcaggggttcgactacgccgtctactggaacaccgggtccggtggtgaagcggcctaccaggtggtgaacgtcgcgtccgggctggtgttgggcgtccaggacatgtccaccgcggacggcggccgggtgatcgtctggggcgacaccggcaccgcggaccaccggtgggtccaggtgcccgacggcggcgccgtgcggttccgcaacgtcaacagcggcaaggtcctcggcgtccagaacatggcgaccaccgacaacgcccccgtcctgcagtgggccgacaacggcaccgccgatcaccgctggacgctggtcgccaacgccgacggctcgtaccggatccgcaacgtcaacagcggccgggtgctcgccgtgtccggcggtgcgagcacctgggggagccaggtggtccagacgtccgacaccggcggcaccggcaacaactggcgtctcgtccgggtcgcctgaccccggacccaccaccacagggagagagctcgtgaagagaaccagaccaatctccgcgtacgcggcggcagccggcgtcggtctgctggcctcgacggccgcggtgatgacggtgcccgcgcacgccgcggccgccgggtgctcggtcacctacgccgtgtcgtcgcagtgggacggcggtttcggcgccaacgtctcggtcaccaacctcggtgatccgctcaccggctggacggtgacctggacgtacggcgccgggcagaccgtgacgcaggcctggaacgccacggtgacccagagcggttcggcggtcaccgcgaagaacgtcgcctacaacggctcggtcgccaccggcggcaccgtgtcgttcggcttcaacggctcgtggaccggcagcaacccggcgccggccgggttcgcggtcaacggcgtcgcctgcaccggatcgccgggctcgccgtccccgtccagtccgtccccgtcgtcgccgtccccgtcgccctcgaccccgggcgggacgtgcacgctgccgtcgacctaccgatggagctcgaccggagcgctcgctcagccgaagtccggctgggtggcgctgaaggacttcaccaacgtcgtctacaacggcaagcacctggtgtacgcgtcggacgtcgccggctccggctacggatcgatggccttcaccccgttcaccgactggtcggacatggccgcggccggccagaacgggatgagccagggcacggtcgcgccgaccctgttctacttcgcgccgaagaacatctgggtgctggcctaccagtgggggcccaccgcgttcagctacaagacctccaccgacccgaccaacgccaacggctggtcggcgccgcagaccctgttcaccggcagcatcaccggctccggcaccggcgtgatcgaccagacgctgatcggcgacgggcagaacatgtacctgttcttcgccggggacaacggcaggatctaccgggcgagcatgccgatcgcgaacttcccgggcagcttcggctcctcgtacaccacggtcctgagcgactcgacgaacaacctgttcgaggccgttcaggtctacagggtgcagggacagaaccagtacctgatgatcgtcgaggcgatcggcagccggggccgctacttccggtcgttcaccgcgagcagcctcggcggctcctggaccccgcaggcggcgtccgagagcaacccgttcgccggcgcggccaacagcggcgccacctggaccaacgacatcagccacggcgacctggtgcggaacaacccggaccagacgatgaccgtcgacccgtgccacctgcagctgttgtaccagggcaagaaccccggtgccggcggcacgtacgaccagctgccctggcgcccgggcctgctgaccctgcagcgctgaccgcctcgacgtcaccggtgcggccaccgccgagggggccgcggtcgaacccgtggtccggcgacgggggatcgcatcagcggtggctccgcacctgaaaaacagtccacggaagtgttatgccgtcggcgtccggaaggtcgaggtgacgccgacggcgatcaccttgaatgtggcgaaacatcctggcaatgttcggtacgcgactgttagcgcgcgcattgtccgccgggccggcgacggtgcgccgcggatcaccagccggcgaggttgacctggcgaccgtggtcgttcacagtctgttggcccgcggtgtgacgatgacgagggaacatggcagctacccggacggacgccgccggtctggtccgggcggctcaggccggtaaccgcgccgcccgcgacgagctggtcggggcgtacctgccggtcgtctacacgatcgtccggcaggccctcgacaccgacccggacgtcgatgacgtggctcaggacatcatgctgcgcgtgctgcggcagctgcggtcgctgcgctccccggacagcttccggtcctggctggtggcgatcgccctgcggcaggtcagcacgcaccagcaccgccgggcccgggacgcggcccgggcggtgccgatcgacgaggccgccggggtgccggacgtcggcgcggagttcgagggcgtcaccggtctgcgcgccgacctgtcggcgcagcgccgccaggtgcgccgggccggccgctggctggacccggacgaccggtccctgctgtcgctgtggctgctggaggcctccgggcacctgacccgggcggagctcgccgacgcgctcggcgtcacggtggtgcacgccggcgtccgcgtccagcggatgcgcgcccagctggaggtgagccgggcgatcgtggcggccctggacgccgagccgcggtgcccccggctcggtgcggagctggccggctggcccgggacgccgggcccgcggtggcgcaaacgcctggcccggcatgtccgtggctgcccggtctgcacccgggcggccggcgatctggtgcccgccgagcgcctgctgcccggcctgctgctgctcccggtgcccgcggcgctgaccgcgacggtgctggccaagagcgtgggtgccggggcggtgctgtccgtcgccgccggcaaggcgctagctagctagcgcacccggtggtgaccgcggtgaccgccggcacgctgatcgtcggcgccaccgcgggcgcggtctcggtgaccgcgccggaggtgccgcgaccggcgacgatcgcgcggaccccgcagccggccaccatcgcggcgccggcgccggtcaccgcacgcgccaccacgggtgccacccggggcaccaccccgaggccggccggaaccggcacgctgcgcgccggtccggtgtcgctggaggcggcgaacgccaccgggcgctacatcacggcggccggcagctacggcatgctgatcgggaccggccggggcggcccggcggcgacccggcaaccggccaccttccgcgcggtggccgggctgaacgaccagcggtgcttctcgttccgcgcggccgacggccgatacctgcggcacgcctcgtggcggctgcggctgaacgccgacgacggcacggcgctgttccgtggggacgccaccttctgccccggcgcgggccaggcggccggctcgatcacgctggagtcgtccaactatccgggctggttcctccggcaccgcggcgacgagctgtgggtggaccagttcgacggttccgcggccttccgggccgacgggtcgttcctggtacgcccggggctggctggctgagccgacccgggcaccgcccgccggataaccgaaaaatgctttcccgattctgttatgcgcgcgtatttgcgctggtcggggtgatcttcgtttgaattcgccggacccgtctggcacgatcgcttcacgaatgtgagcgctcccattccggtttccgcacgcgaacgcaccgcctgccggccccgaccggcggcgaccccatccccgaaaggcaccacccccatgaacgcacggagccggccccgccggttacgcacgctgctgcccgtcctgctcaccgcgacggtggccgccggagcggcgctgttcttcgccggcacctccgacgcggcgagcaccctgggcgcctcggccaccgcccgcaaccgctacttcggcgccgcgatcgccgcctcgaagctgggcgacgccacctacgccgggatcctgaagcgcgagttcaccgcggtcaccccggagaacgagatgaagtgggacgcgaccgagccgtcccggggatcgttcaccttcaccgccggcgaccggatcgtcacccaggcgcaggccaacgggcagcgggtccgcgggcacacgctcgcctggcactcgcagatgccgggctgggcgcaggcgctgtccggcagcaccctgcggtcggcgatgctcaaccacgtcacccaggtcgccacccactaccgcggcaagatctatgcctgggacgtggtgaacgaggcgttcgccgacgacgggcgggggacccgccgtgactccagcctccagcgcaccggcaacgactggatcgaggccgcgttcaaggccgcgcggaccgccgacccgtcggccaggctctgctacaacgactacaacaccgacggcatcaatgccaagagcaccgcggtgtacgccatggtcaaggacttcaaggcgcgcggcgtgccgatcgactgcgtcggcttccagtcccacctgaccggcgcgatgcccgccgactaccaggccaacctgcagcggttcgccgacctcggcgtcgacgtgcagatcaccgagctggacatcgccggctccgggcaggccgacgcgtacgccgcggtcacccgggcctgcctggcggtcgcccggtgcgccggcatcacggtctggggcatccgggacagcgactcctggcggaccggcaccaacccgctgctgttcgacgccggcggcgccaagaaggcggcctacaccgcggtgctcaacgcgctgaacgccggtggcggttcgaccggctcgaccatcgccccggccacggcgatcgacaccagcgcctggtatgtgctggtcaaccgcaacagtggcaaggcgctggacgtgtacaacctggcgaccaccgacggtgcgcggatcgcccagttcacccgtaacgatcagacgcagcagcagtggcagttcgtcgactccggcggtggcttctaccggctgaagtcgaagctgtccggcaaggtcctggacgtctccggcaagtcgaccgccgacggcggcgcgatcgtccagtgggccgacaacaagggcgccaaccagcagttcagcgtgcagtccggcaacggcttcatccagctgatcaaccggaacagcggcaaggccgtcgaggtgcagggcgccgccaccaccgacggcgccaacgtcgtgcagtacaccgacgggaacggcaccaaccagcagtggcagctcgttccggtcggcggcgggagcactcccaccacctcgccggcctccggatcgtgtgcgcttccgtcgtcctaccgctggacgtcgaccggcgcgctcgccacgccgaagtccggccgggtcgcgctgaaggacttcacgaccgttccctacaacggcaggcacctggtgtacgccacaacccacgacaccgggtcgagctggggttcgatgagcttcagcccgttcaccgactggaccgacatggcctcggcgacgcagaactcgatgaacttcgccgcggtcgcgccgaccctgttctacttcgcgccgaagagcatctgggtgctcgcctaccagtggggcggctcggcgttctcctaccgcacctccagcgacccgagcaacccgaacggctggtcggcggcgaagaccctgttctccggcagcatcaccggctccggcaccggcccgatcgaccagacgctgatcggcgacggcacgaacatgtacctgttcttcgccggggacaacggcaagatctaccgggcgagcatgccgatcggcaccttcccgggcagtttcggcacgtcgtcggcggtggtgatgagcgacagcaccagcaacctgttcgaggcggtgcaggtctacaaggtgcaggggcagagccggtacctgatgatcgtcgaggcggtggggtccggcgggcgctacttccggtcgttcaccgcgaccagcctgggcggctcctggaccccgcaggcggccaccgaggccaacccgttcgccggcaaggccaacagcggcgccacgtggaccaacgacatcagtcacggtgagctggtccgggccaccgcggatcagacgatgaccgtggacccgtgccacctgcagctgctgtaccagggccgctcgcccagctcgggcggcgactacggcctgctgccgtaccggcccggggtgctgaccctgcagcgctgacgcgaccggtccgtggggcgtccgcaccccggtgaggacgcccacggaccgtcgtactgtgcaataaagtttaaaattgtaggaggttgacaagatcattgcggtcgcgttgactccggggatcgctttcgcgaagaccattcgccctgttcccgttcaccctcaggtgtgccggtaccccgcgccacctgtcgggtcccccaggagtcacctcgatgccggagtccccccgctccgaccgccggccgatactggcgctcgctgccgcaaccctgaccgttcttgtcggctactcggccgtcgccaccttcctgctccggacggaacgctcaccgcaggccatgccggcgccgcaaccgccgccggtgtggaccatgccgtcggcccagccaccggtctccgtcgccccggcacccagcacccggccggtcctcgacccggtgtcccggcacagccccgccgcgcccgtcccgccgccgcgccccagccggaccacggccggccgccgcaccgcaccgccccgcctcctcgccgggaccacgctcgggctcggcttcgccggcttccccgaataccggatccgccgctgggacaccgccgtcatcgtcgccgcggtcacggccgcgagcagctcgcacgaccggcgcgacgcccggttcacggtgcgggccggacgggccgacccccgctgcgtctcgttcgaatcggccggcgaacccggacgcttcctgcggcaccgcgaattcctgctgcggctcgagccggccgacggcagctcgctgttcgaccaggacgccaccttctgcccggaacgcaccggcggcggattcgcgctgcggtcggtgaactatccgcagcgccacctgatgctggccgccgacggcatccgcctggaaccgtccgcgaccaggcaggcgaccgtcttcgaagcctgcccggccctgtgacagcatcgttccgggacgacgaccggcttccgcaccgccccgaacccgagacggcgccgcaccccgccggcgaccgccctggccgccgccctggccgcctagctagctagtcggcgccgcgcgcgccgaagccgaccggctggtcagccaggccgaactcagcgcctccacggtggtcagcgacgcccggcaccggcacaccgaggcggtccggacgctcgccgccgaacgggacgccgcccgctccgacatcgaccggctgctgctggtgatcacggcgcagcgggagacgctgcggcagcacatcaaccagcggttggacgagctggccgacgggcgaccccggctggcaccccggggctgagcgtcaggaggcgtaccggcgctcggcccgggcccgcgccttcgccgcctccacctcccggtcccgcggcgcggcggtcgtcaccaggccgtccagcagagcctgcgtggccgccgtgatcgccgcgaccgcctcgtcgaagaccgcctggttggcctgcgacggccgggtcgtcccggcgatcttgcggacgtactgcagggcggcggcctgcacctcgtcggtcgtcgccggcggctcgaagttgtgcaactggtggatgctgcggcacacgttcggctccttcgcggttacccgatgtcgccaagaatctatgccatccggaccctaagcttgtcccatgggcgcctactggtacgagtcatccatcgaccgccagctgcgtgaggccaccgagcgcggcgagttcgacaacctgcccggggcggggaagccgctcgccggccacggcgaggagtacgacgaggactggtgggtcaaggactggctgcgccgggagggcgcgaccgccggcgtggtcccgcccaccctggccctgcgccgggccgccgaggatctgacgacggtggtcgaccgcctgcacaccgagcgcgaggtccgggagcatgtcgcggacctcaacacccggatcgacaaggcccggcgcgggcacctggacggcccgccggtgatcctgccaccgttcgacgcggacgccgtggtgcgagcctggcgaatcagaagaccctgatggtcctggcgatgctgggcacccccttggcgtccacggcgaacatcatccagtaaccgggcaccgccactcccgggtccgccggaatggtcagctggtaaccaccactcacggccacctgcggcaacgacaaccgtcgctggtcggtgtcgacgctgtgggtcgcggtccccatccgtacgagcgcgaacgacttgatgctcttgtcggtggtgacggtgatcttcgacccgttggcggccgtcgtcggcgccgaggtgatcaccggccgcgacttgacacccaccaggtacggcggggtgaagatctccgcgtcgaagtggttggtcgcgcatccggcgccgcacagcccgccgccgccggtgaacacccggccgtccggcatcagcagcgccacgctgtgataggtgcgcggcatcgcggccggtgacagcggactgaacgtctcggtgaccggatcgaacaactccgcctgcagcaccgccgtgttgtcggagaacggcaccggatagttctgcccgccgaagaccgccaccttgccgtcgggcagcaccacgctgttgtggaaggcgcgggcgttggccatcggcgcgatcttccgggtggtcaccgtgctgccggcgatggtcagcacgtacgcgttggcggtcgcgtcgttgttctcgtagttcggcgccccgcccacggtgaggatcttgccggtgtcgtacatgaccgcgttgccgttcatcgcgtcgccgtcgtcgccgcgcaccccggccgggctgaccccgccggtcccggcggtggtataccagttcatcgcccggctcggcccggcctgcagcaccctgccgccggaccaggcgaacagccaggcgtggttgtccttgcggtagtcgccgttcgggttgctgtccgcggtcagcatcggggccgcgtccgcgccgggcagcgcggtccatccggtggccggggagaacacctcgccggccttgtgccggccgccgttgaccccgccggccccgccgctccacgacccgccgacggtgaacacccgtccgtccccgagggtggcactggcctggtagccgcgcggcgtggtcatcgccggcccggcggtccaggcgtccgtggccgggtcgtagatgctggtcttctcactgttgttgccgccggtgacgacgatccggccgtccggcagcgtggcgatgccggggcagaacatgtcgtgcccggtctcgctgaccgaccgctgggtgaccaccccggtcgccggatcgtaggtggcggtcagggtcagcccgccgccgccgctgaacgtgtcggccttgaacgccgaccaggtcaggatcctgccgttgggcagctgcgcggcggccaccgggaccagcgggaagccgaccggggcgctccacacgccgcgtttcggggccaccgagccggccggcccgagcaggtcgagctcggcggcgctgctccacgggccgcgggtgccggcctcggtgaccgcggtcagccgcacgtagcgggcggtggccggcgggaagatcaccgtctgccgggccgggttgtccgcgaacaccccgtcggtcacccggtcggtccaggtggtcgcgtcgctcgaggtggcgatccggtagcggccgatccggccgttcggtgaggcggggcgcggcagataggacaggccgcccaccggtacggcgtggtgcagatccaccgtgaccgagtgtggcagtcccggcaccggcgtggcactccacgcgctgtgccagatggtcgccgggtcgccgtcgagcacgttgaccgcccgcccgttctccgcggcggtctcctcgctgtcggcggtcaccgtccaaccggtgcgggccagggtcgggtcgggccggccgagcaggttgatctccgcggcgctgctccacgggccgcggttgccggcctcgctgagcgcggtgatccgcacgaaccgggccagggccggggcgaacgtgaccgtctgcgcgtcctggctgtcgatgaacgcgccggtcgcggcggccggcccccaggtggtgccgtccatgctggtttcgatccggtaccgcccgatcagcccgttgcggccgccgtcctgccggggcaggtagctgagcccggacaccaggttggtgacccgcatgtcgacggtgaaggtgtgcggcagcggggcagccggcgccacgctgtacgcggtgtgccagatcgacctggtgtcaccgtccagggcgttggccgcggcgccgttcgccgcggccgtctcctggctgtccgcggtggccgtccagccggtccggggcagcgccgggtcggtgccgccgagcaggtcgacctcggcggcggcgacctgcctgccgcggttgcccgcctcggtgaccgcgaccagccgcacgtaccgggtgatcaccgtgccgaacgtgacggtcttgagcgtggcgtcgtcggcgaacgtgccggtggccaccggggcggcccaggtggtgccgttgtcgctggtctgcacccggtaccggccgatccggccggtggcggtgctcgcccgcggcaggtaggtgaggccgctgacggcgacccggttgccggtgtcgatcgccagccggtgcggcagcgcggtggtgccgctgagccaggcggtgcccgcggcgccgtcgatcgccttggcggcggaggtctgtccgctgtccgcggtcaccttccagccggtgtgcggcagcggcagcgcggtggtgaccgcgaccgggacggccgtgggcaggatgtggccggcgtgcgggtcggcggccggggcggcccgcccggaccggtgcagggccactgccgtgccgaggagcaggcacaggctcagggtcgccgcgaggcgtacgcgcatggatgtcctccgtggtgggttcgacagaaccccaccgcattcgtctatgtcatttgcgggaaggtcggaagctggacacgaaaaaatcggccccggcgctgagcgccggagccggtcggagcggaatgtcagctttcggtgatctgcagcggctgcccggtgagcgtgttgcagctgacgaacgccagatcgatggtcacgttggtgaaccagaggatcggcagcgtcagcggcggcggctgctccggggtgaaggtgaccgggatcaggccgaacaggttgccggtcatcttcggggtgtagaagtgcacgttgccggtggtggtcagctcggcgctcttgatcgtggtgaccgcgtcgccgggctcgtcgatggtcaggctgaacggcttgttgaccgccttgtccatgtcgaactgcagcgccttgatcgtgccgttcgcggtcgggacgtcggcgacacccttgtaggtcgagttgtacatggtcagcgagtcgaccttcatgacgcccggcttgatcgccgaccgcggcacgctgccgtcggcgaccacgttctcctggcgggcgccgaggcacgggatgacatccgagtcggcggcgggcttgctggtggtcctggccggagcgggcgccgtggtcttggccggtgccgcgcccggggcggtggtcccggtcgcggccggctcggccgccttgctcgccgacgccgacggcgacgcgctcggtgcgggcgactcgttgccaccgatgccgagcaggttgccgacgccgtcgaccacgctgtggatgccgtcgacgatcgggttgctgtcgttcgacgccgcggcggccgaggtgctggtggccggcgcgggcgtggtggtggtggcggtcttggtgggcgtcttgccggccggccgggccgggatggtcgccggggtcttcttgccgccggtcttgctgggtgacgcggaggtcttgatcgacggcaggccggccgggcagtcgtcggcgctggccgggagccggctgccgatcagcatggtcgcgccgaccaggatcggcagggtgatgatcgcgagcgccttgcggttcaggccgcggcgcgggccgggcaggctcccgcgggggtcctcaccctcgggctcgggcgccaggccgggcaggatgctcgggtcgctgaccaccggctgctcgtgcggccggtcgtcgtgcccggcaacctcgaggtgccgggtgtcggtgccctcggccggcaccggctcgccctgggacggtccggcgaagtcgagcgggccctgcagggcggtggccggccggtggggcgccggcgaccaggagagcgcgagcgcgccaccgacgatgccgagcagcatgccgatgaaccagccgccgaggttcagcccgatgaacgagtagagcgcggtgagcaggccgacgatgccgtagaacatccgctgggccggcgagaacatcaccagcgcgccgcagatcagcatcaggatcggcagcaggtacgacaggaagccctgcgggccgatgtgaatctgcaggttgcccagcgacaggttcgagctgtacagcagctccaggcccgacagaagcaggagcagacccgaccagaacggccgtgcgcgccgccaccggcggaacttgctccagaaatcgtccgtcgccactcgtcgtcctccaggaaaaaaggtcacacaaaggggtggggctcgcggggtggtgctccgcgagccccggtggaactagatcagtagcactcgttgccgtcgccggtgaggagcttgaggctcatcccggtcagcttgaacgtcgaggccgacgtcgagtacgcctgctgcttcaggctgttgatggtgacgtgctcggcctgctgaccgaaaccaccgaccgcacccttcgcgtcgccggcccggttgaggttgccggcgtcccgaccgatctcgatgttggtgaacgtcgcgtcgccgctcagctcggacatcccgatcagcaggttggaggcctggaccttcttcgagtcgtcgtccgacgccttgacgccggtcgccgccttgatctgcagggtgatcgtgcccagcggggtcttctgggagaccgactggcacaggttggtgatcgtcgcgctcgagatgccggacatggcggccgcgcgcggcttgccgctgccgtcgaccagcgcgtcgctgtactgcgtgaagccgttgccctcgagggtgtcggcgctcagcttgaactgcgtgccggagatgacgaagttggcggccagggcgcccgtctgcagcgccaccaccaggccggccgcaacggcggtcggcacgccaacggcgacggcgaaccggcgccagttggtccgtccggtggccggagcgctctgcgaatcctccacggatcctcctataaaagagtgacggccggtaccggcctgctgttgatggctcgcatcgacgggcgacacttctgccaaccgtcaacagagaggcgagtcgatgccgtcgtcgtaacgttcgggaaatgttgccgccccggcacggtgactacaagggccatggctactagtcagtaacccacatcacttgatcttgttaacgcagcgtgatgccgctgtccgcggtgtccgaaataccggcggtaaagcggacaagtggtccggtttcctgagtgtggcaatcaccacaagtgacgagacatcgtcggtcacggatcggtaacgaaatccagagatctctcagaaatcgctgtctcccaccacttcgccgaggtcgaccctccaccgaacgggtaagtccggccgggtcgctgccgatgtgaggggcgtgagactgcaacgccggctcaacctgggcttcgccgccctgctcgggctgttcacggcgttcctcgtggtgcagttcggcaccggcgggcggctgcgcgacgaccacgaccgccggtccgcccggatcgccgcggcccgcgaggccaatcaacacgccctgcaacggatgaccgacgccgaaaccggggtgcgcggctaccagctcaccggggagcggctcttcctggagccctacgagaacggccggggcgccgccctcgccgcgctcggcaccgccgccgaacagacccgcgacccgcaggtccgggagctggtcgaggccgagcggcaggccgcctacgactggctcgcccagtacgccgcctcggtgatcgaccggcagtcccgcgccacccggaccgatccggcgctcggcaaacacctcttcgaccgggtccgggcactcaacgccgcggcggacgacgcgatcgccgccgagcagcacgccgagaacgcggccggccgacgccggagccggatcctgggcgccggctcggccgcgctggtgctggccgtgctcgccgccggttacctgctggtccgggtcagccggcgacagctgctggtgccgctggcccggctcggcgacacgatccgccggcaggccgccggcgaccggtcggcccgcgccgagctcctcggcgcggcggaactgcgtaccgtcatcgaagctttgaacgatctttccgcgcagaccgaggaactgctcgccgccgagcaggcccgcaccgcccgcgcctggctctgccaggcggtcgtcgccgagctgcagcaggagggcgccgacccggcgcaggtcggtcaccgggtggtcgcccggatcggcggggcgctcggcgccgacgccgtgcacggcaacctgttcgtccccggtaccggtcagatcgcggtccgctggccgccggaggcgcccgacccggcgccggacgccgtcaccgggatccgggacatgcccgccgggcagcccgcgatccgcgccggcggcctggccgtcacgatcggcggcgaccccgactgcccgggcggctgggtgctggtggtccgcgagttcctgccccagttcaccgccccggagcaccgcctgctggccagcgtggccggcgagatcgaacgggcgctgcgccagctcggcatccgggtgcaccaggagctgctgatcggccagctgcggatgctcgaccagcgcaaggacgtcttcatccagaccgtcacccacgagctgcgcacgccgctgaccagcattctcggctacgccgagatgctcgccgacgaggacgaggaactgaacccgatgcagcgccggtcgctcaatgcgatcctacgcaacgggcaccgcctccaggacaccatcaacgacctgctgctgctggaccggccggcgaccgccgtggacgcggtcaccgaacccctcgacctggccgtcctggccaccaccgtgcacgccgagctgcaggccgccgcccaggccaagaacctggcggtcactctcgacgcggcgcccgcctgggttcgcggcgaccgcacgcagctgcagcgggcgctgcgcaaactgctggagaacgcgatcaagttcaccgccgccgggggcagcgtcacctggggctgtgacgcggacagccggcacgtcacggtgacggtcaccgacaccggcatcggcatcccgccggaggacgtgtccggtctgttcaccccgttccaccgggccggcaatgcgatggaccaggcggtccagggccccgggctgggcctggcgatcgtccgcgacatcgtccgcgaccacggcggggcgatcgcggtgcagtcggtggtcggccgcggcacgaccttcacggtgaccctgccggctgttccggcgccggtggccctgccggtctcctgaggccctttcgggccaccggggggatctgcggcccactcacgatccgctcggggtcgcgaccgcctccgattgcggcgtacgcggtcagccgcccccggaggtcggggcggcggattcccggatccctgggcgcccggacggtgaccggtccgccgtgcgggcgggtttcgccggggcggggcgggggctagattgcgggaaagtgggatcgacggctctggatggctgccatggcggatcagatcattgcgggtgggttccggatcgtggtggacccggtctcggattcggtgaggctttcggcgatcttcgcggtgctcccgctgctgacgctctttctgctgctcggggtgttccgggtgcgggcgtggctggccggggtgatctcgctggtcgtggcgctggtcgtggcgatcgccggctacgcgatgccggtcgggcaggcgctgctgtcggcgagcgagggtgcggcattcgggttcttccccattctgtggatcgtgatcaatgcgatctgggtgtacaacctgaccgttgtcagcgggcatttcgacgtgctgcggcgatcgatggaacgggtcagcccggacatgcggattcaggcgatcatcgtggcgttctgtttcggggcgctgctcgaagcgctcgccggcttcgggacgccggtcgcggtcaccgtggtgatgctgacggcgctcgggttcgcgccgatccgggcggcctcggtggcgctgatcgcgaacacggcgccggtcgcgttcggggcgctggccacgccgatcgtgacgctggcgacggtgacgtcgggggccgggaacgacccgcgactgaccaccgacacgctcggggcgatggtcggtcggcagaccccggtgctggccctcgtcgtaccgcttatcctggtcttcgtggtggacggccgccgcggggtgcggcaggcctggccggcggcggcggtggcgggtctggttttcgcggtggcgcagttcgtggcgtcgaaccatctgtcggtgccgctgaccgacatcgtcgcctcgctggcggcggccgccgcggtggtcctgctgctgcgtctctggcagccggctcgcgccgtcgggtcaagcccgctgaccggagccgcctagctagctaggcggggaagggccgccgaccggaaccgcccagcgccgggacgtcgccgtcgaggggagcctgctgagcggaaccggactgcgccgggatgcgccggccgaggtggcccgcgcctacgctccgtacctgatcatcatcgtgatcttcgcgatcgcgaacctcgggccggtcaagtcggcgctggcgcgatccccctggacggtgatcttcgcgtggcccggcctgcacgtgctgagtgccaccggcaaaccgctgtcctcgacgaacttcaccctgggctggctgccggccgccggcaccctgctgatcatcgcgggcatcctgagcgccgtcgtgctgcgggtccgccccggtgcggcggcccgggcctacggtcggacgtacgccgaactccgccagccgatcgtcaccgtgatggcggtgctggccctggcgtacgtgctgaaccagtccggacagacgaacaccctcggggcgttcctggccacggccggcggcgtgttcgtcttcctgtccccgatcctcggctggatcggcgtcgccgtgaccggttcggacacctcggcgaacgcgctgttcggcgccctgcaggtgcagaccgcggcgaaggccgggctggatccgctgctgctggccgcggcgaactcgtcgggcggggtgttgggcaagatggtcagcccgcagaacctggcgatcgccgcgggtgcggtcgggatggccgggcgggagggggacatcttccggaaggtcatcctctggagcgcggtgctgctgctcggcatgtgtgtgctggtcacgctgcagagcacaccgatcctgggatggatgatcccgggatagccacctccgggtactgaacgcggggacgcccggcgcggtatgcctgggtgagtatccgcctgaccaccgtccgtgaggagtcccgggcatggccgacctcatcctgatggctgaccgcatccacaccctgacccccggaatccggcccaccgcggtcgccgtcgccggcggccggatcaccgccctcggcgaccgggccgacgtgcgggactggcgcggtcccggcacccggatcatcgacgtcggcacggcgacgatcacgccggggctggtggacgggcacacccacccggtgcacggcatcgggttgacgcgcggcctggatctgtccggcgtacacacgcttgcggggttgaaggacgctctgcgttccgcgtcctcggtgtgcgccgcgccggacggctggttggagggctggggtctggatccggacgcgttcaagggggcgccactgaccgccgcgccgctgatcgaggtgctcggcccgcacgtgccggtcttcctgcggttcttcgacgcgcactcggcgctggtcagcccgcgggcgctggacatcgccgggccggccgcgcggtcgcacgccggcgtcgtccgcgacgcggacgggcagccgaccggctgtctgctcgaactggaagccgtcgaaacggtgcgcgccgtcctgccgccagacccgcccggcacccggctccgccggctccgggaactgctgacccggatggcggccagcgggctgaccgcggcgaacgcgatggacttcgaggaggactcactcgcgctgttccgcgccctcgaagacgccggtgacctgccgatgcggtggcggtgcgcgccgctggtcacacccggcgccgacctcgccgacatcgtcgccaaacagcgcctgcacggacggcgctggcaggtcgaaggagcaaaattcatgattgacggtacggtcgacggcggcaccgcgtggctcgacgaacccgacagtctcggcgagtcgaccgccagcatctggcccgacccgggcgaatacgccgccgcggcccgccacctcgccgggcacggggtgccgacggtgagccacgcgatcggcgacgccgggatccgctacgcgctcgacaccgtcggccggctgccgcggcagcgggtgccgcaccggatcgaacacctcgaaacgatgccgggcgacctgatcggacggttcgccgcactcgacgtgaccgccagcatgcagccgacccactgcacccatcacacccgggccgaccacaccgacaactggtcgcggcggctcgggaaactgcgggccgaccgggcgtttcgggctcgggacctgcgggacagcggggcacggctggtgctcggatcggactggccgatcgcgccgttcgacccgcggggaatcctggcggcggcccggctgcgccggccggccggggcggtggacacgtcgccggtgctgcctgcacaggggttgacggcgcggatggcgttggaggggtatacgtcgcaggcggcggaagcggcggggatcggggactcggggcggatcgcggccggatgccgggcggatttctcggtgttcgagctggatccgttgggggtggatgcggatgagttcgccgagtcggcggtggtgatgaccgtggtggagggggacgttctcttcggaggatctttcgccgcggacggttgaggatttctcgccgcaggctccggcggtttctctgcacgggcttcgggtggcctccctgcgcgggcttccggcgacctctctgcgcgggcttcgggtggcctccctgcgcgggcttccggcgacctctctgcgcgggcttcgggtggcctctctgcacgggctcccggcggcctctctgcgcgggcttccggcggttcctctgcgcgggcttccggtggtttctgcggggcttccggcggttggtctgtgcgggcttcagcgctggccctgcatcggccgggattgatgccgagggtgcgtgggaaatgcatgcgttccggcctcagccggcgccgttcggtgtcgggcgaggagatcgggacgcccgcaccggcatgcggagtggtgacgatgtcagctcagggaccagcgctggtcggaggcaccggtgcaggtgacgaccacgacccgcgtgccggggcgggcgccctgcgacggatcggtcaggcagcggttgctcgccgcgttgatcagctgatggtcgccggtgatccgccattgcgccgtggtccgtaggtcgcacgaggtcaagtgcaccgtgctgtcacccaccaacagcgcgcacttgcccatcacctgcagcgtgccgtcggttccgagcgtccacacctgcgcagccgaccggttgcagtcgaacacctggatgacactgtcatcgaccgggaccgcccccggcaggtcgaggcagagcccgttcccactgaccagaatgccggtgccagccgtacccgaacccaccacgaccgccgccggcgcctgggccccggcgctggccgccgagctcacgcccgccgccgcggaagccgaacccccgatcctgctaggcgtcacactcaccgcggctgtgggcgtggcagtccggttcacccccggaccaccaccggtcccggtgccgccgtgcgcaccgaccaccaccccggcggtccccgcggcggtagtcgtggcctcggtagtccccggcccggttactgccggaaacgagggtcggggcaggtccgcggagagcgccggatcaaattcgggccgcagagccgcatacccggccaccgccagaaccaccaccgcacccgcacccaccccggccaccagcaccggccgccgccgcgtcccgaacaaccgccgtgcccgcccaccagcctgtgtccgcccgtcagtgcgtgtgggcccgtcagcgcgtgtgggcccgtcagcccgtgcccgcccaccagcctgtgtccgtccgtcagcgcgtgtgggcccatcagcccgcgccagcccgtcagcccgtgccccagctgtcgaacccactcccgagccgcccgacccgaaccggtttccaccggccccagcgctaccggccccagagccacccgccccggagccacccgccccggagccacccgaccgggaggcgctcgatcctcccggccccgagccgcccgagtacaccggcagcacctgggtcaccgagtccggcgccgccccggccggccaggtagccccggaagcctcagcgtccccggcgcccccctcctgggcgacaaacggccgcaccagcagcgggtcttggtcagtaccgagatcctcgtcgtccacggacagacccaccccccccgatcgacatcgatgaaccaacttaccggcccagcccaccccgcgcgggccccgttcggccgaccccacccccgtccggaccgtcaaccaccccctgcagccagcccttctaccgccatgaacagcggctatgcctccgagcgcgagccatcccaccgaagtgtcacagctcactggcgagccgcattttccaagccacaccgccactccccggggtgccaccgagtcgccaccccggcgtgcagcgcgtactttccccatgccgcccgcagtcgcgccgcaccgttcaccctctccggcagcccgagcgccacagcgctccacggcaacatcggcgcggaccgcccacacagcgcgggtttcgatctgcacggaccggttcgagacgaccgaaccggctgcgaagcctgctgaacaatcacccttggctgacgtgtcacgacctgagcgacgccgcacgacttcggccggagcggcatgagcgggactgtcaagaaaacggtgtaactcgatgttgttgaaggtcagttgcggcctgcggtgagtcgtccttcgaaggcgaagtcgaaggcgttgagggcgggtttccagcggatcgcccagcggcggcggccggtgccggtcgggtcgagggacatcacggcgaggtagacgcatttcagggcggcctgctcattcgggaagtgcccgcgggcccggaccgcccggcggatgcgggcgttcacgctctcgatggcgttcgtggctagctagctaggcatgagcgggcaacggcaggcgcggctcggtcggtggggcccgggcggccggaatggacgcccgggcgtagtggtgtcagcgcttccagcgggcgtagtggtgtcagcgcttccagaagggcttggtcgctcgtttcggtgaggtgggtgcgccgaattcggtcagaacccgcagggcggtggaccacttctcggcgagtggggcgttgccgttcagcagcgtgatcagagcctgcaagggaccgaagtcgtcgccggataggggagtcagcaggacggtgaggcggctggcgaggtcgtccagcaggtcgcgacgctcgtagtcggggtggtcggcggcgtcgcgcaaccgtcctgcttcgaccgtggccagctgccggatgtcggcgagcgggatgccggcgtcggcgggttgccgcgaccgaccgaaaccgcgcggggaaacccggccgccgccggccgggaggccgcttgcggatcgcggcacgccaccagcgggagacggcgggccgcctgcgggagactgcgggccgcctgcgggagacgtcgggccgcttgcggacgccggcacgctaccggtgggtgccgatgagccacctgcgggggtcgatgcgtcgctggtgggtgcgggtgggctggccgcaggtgaagcggggctgtccgcggagggcggagggccgccgacaatcggaggctgacccgcaagcctggcgtcgtcgaacgcgtccggctggcggtgggatgcacgcagtttggcgctggccggggcgaagcgcgggcggctcggcaccgggccgcccgggatcggcggtgccggcgggaacatcccgggtgcggccggcgccggtccgcccgggaacggagaggacgccgaggccaggatcatgccggcggccatcgggggtgccgtggactcccagcctgagggcatctcgacgggctgggtcacgcgccggacctcgccgccctcgttgaccacgcgctcgtcgacggcgacataggcggtgaagcggcacaacacgccgaaacgcagggaggtctcgacgatctgctgctccagcgtgtggtcgccggccgcgaaggcatcctcgaggtcgcgcaggcgggcccgagcccactgcttggtcaccgcaggctcggcacgctcccgcagggggatggtggcctggaacgcctgctcgtcccgagtggtcccggtcaccgtgaaggtccccgccgtcgacccggaatagcggccggtgaccaccagcggcactcccggatagagcccgggcagtcgctggggactgcgcgtcccctccagcgcggtgacatcatcggcggtcagggacagcccggtgaccacgggagcgccgatccgccggtggatgtgctccatcgcctcgtccagccggtcctcgctctcgaccagctcggcccggccggcgccgagcgcggccagccgcccgaggaagccggcgttgaccgcgcggtcgatgccgatggtgtgcagccgggtgctgccgatcagtggggtcacctcgtggacgatctgatcctcgttgcccacctgaccgtcggtgaccagcaccaggacacggtcccgtccggtgctgtcggcgagcagtccgagcccggtggtgagtggggtgagcagctcggtgccgccccgggcgtcggctcgggccaggtgctcgatcgcgcggaaccgattgcggtcggtggcctcgctcagccccggctccacaccgtcggggcgctcgacctggtggtcgaaggtgagcacggcgaagcggtcggcgccggtcagggtgtcgatcacgcgtgccgcggcgcggcgggcggccaccatcttccatccgcccatgctgccggaacggtcgaggagcagcaccacgtccttcggccggggtggcacgtcgccggcggggggcaggatcacgatctgatacgtcccctcctcaccatcgttgtcgggcaccgccaccgcggtgttgccacccggtgcgtaggccagacgcagcacgaagtcacggtcggcccgctcgcccggagcgatccgtagcgtgccgccctcctcggagatcgcatgcaggctggagcggacctcgccgagctccagaccggccgcgtcgacggtcacgccgagggacagtcgcagggggttgggaaatccgggcagcagcaccggcggggagatgcgggaagcgtccggcaccgcgtcggtgtcggcggtctggccgtccccggcatacgggccggggagtggtgcacccggaatgtagcgaggggcgacgaccaggggaaaacggtaggtggcggcgccgtcctcgaacggcatcgggccgaccaggctcagccgcacgacgatccgctcgccggccaggatgttgccggcccgcatggtgaacacgtcgggccgctcctcctcggcgatcgaggcccgctgaccggcggccacggcctggtcatactgctcgcgggcggcggcacgctcctgcagctcggcggtgaccgtgcggccgtcggcggtcatcgtcatgccgacgaccgcggcccggtcgggcagtgggaagacgtaggtcgcctcgagggcggtgtcgtgcgtgttgacaaactcggcggtcacctcggtgcgggcgaccagcccactgatcgcggcctgcacgtcgagccggtcgagaggcagattgccgcggtcggtgcgcaacgagccgaacccggatccgggcgccggcctgacccgctccagctcgcccggccccatcggattgacgtagataatcacgaatctctcctatcggtgagcccacgggatgcgagcaggtcgagcaggggccgggccgcggttgcgagctgggtgcggtcgatgcgatcgagatgaaatgaaccggggaccagcaggatcagccctgagccgagcggcaccccggtaagtagggcgtcggcgccgatcggcggcgccgtgcccgggtcgccggccggtgatggcacctccgcgaggcctgagggggcctccgactgtgggaaggcccaatcgagcgcgtgcgtcggtgccgtctgaggagcgggtggcgatttccagaacggcggccggggcgtcgcgggcggcggcgatggatcggcctcgagcagctcggacggcacccgggccagatcggtgagcgactcgtccgatgccccgctcaggtccgcctggatctcggcgagggtgcgtccggccgcctgcagtctcttgatcgcgacgagctgcatgagatgccgcgggccgtagagcgcggtgcggccgcgcgtgccgagggggcggtcgaccaggccgatcgtcgaataccaccggatcgagcggcgatccggcagatcccggacgcggccgttgggcgcgccggaatactccgcggcgagtgcggtgcgcacccggtcgaccagctcctccatcgtccacatgagcagagcatgacactgtcatggtgacagtgtcaatgattcgtggcaggatgagcggcatgctggatcggctgaggctggtgagcctctcgcacgtgaacgaccccgcgcggatcagcgtctttcccggtgatccgccgttcgagctggacaccgttgccacgctcggcggggagggcttctatctgcgagcggtgcgcggcggcgagcacaccggcacgcactggggcgctccgggccacttcaccgagggcgggctgctcgccgacgagctggagccggccgacctgttccggccggcggtgaaggtcgacgtgcggtccgcgtgcgcggccgaccccgcatatgcggtgaccatcggcgacctgcaggactgggaggggcggcacggccgcatcccggacgagtctttcgtgatcatttggaccgggtgggaggagagattcggatgcgcggatttcgagcggcatcccgggttcgccccggagacggtgcgctggctggtggagaccggccggctgggggagcggggcggcaccggcacggacgcgttcagccccgatgtcagcagcgacgccggcttcacggtttcccgactggtctatcagcgccgccgggtcagcctcgaggtgctggcccatctcgcagatctgcccgccaccggcgcgtgggtcctgtgtggcgggcagatcaaccgggccggttccggttcgacggcgctgatctacggagtggtgccgccggcggccggctgaccgtggccggagccggccgtggggtgcgccgggctcgcgccgggtgtggcgtggccctgggtgacgcccgcagtgctgcggctgcgggtggggctcggcgtgggatggcccggggtggggtggctcggggtggagtggctcggtgcggcgccgggtgtggcgtgacccggggtgttgcccgctgtgctgtggcccttggtggtggtggacgcggccgggggcggggtcgcggtctgaccgccgccgggctggacgacgccgtccacggtcagggtgtacggggcgtactgggtgaccgttccggtcgggtcgtcctgtgcgacgatcgcgacgaccttcgggaagccgcgcagcgccgcgacctcggtgatcggcacgaccgcggcgcgcaggtggcccagcccgaccagcgagacgtgccagccgcgcaccgggatggggtgccactgggtgggcgacttccagccgtccagcgagtcactggtgatcttgctggcgccgagggtcacctcgccgaggtgccacccgccgaggttgaccgcggcgtcggtcacgtagcggaagccgagcaggatcttcttacccgcgtacgccttgaggtcgtaattctctttgacgtccgcggcctgaccggtgatcgcgggcccgagtggtcccttgaccgtgttgttgccctcgatcgcctggtacgtcttgcctccgtccgccgagacggtgacgtacccgtagtcgaagtccttctccatgccgtaagtggttttgaaccggagcaccggatcggcggtcggcacctcgacctgacgggccgcggtctcgtcgagatccgacgtgttcccggagaagagcaggcccgcatcgatcttccaggccagcggcgtcggcggcagggtcggcgccccgctgaacgccaccgacttgatcagaccctgcggcaggcggatgaaatccgccccgttcggcgcggcgcccgacttgtcataggtggccgggttcgcgagattgaccgtcgactggagctccgccgcggtcacgcggtcgcgcggcactccggtgaccgtcccgccgggctcgccgacctccttgtcgaccagggtcatcacctggaagtcgtgcagcacgtcggcgaccttgaggcccttgggcagggcggtctgcagcgcgtcgagcgactggtgcttggcgtcgcggtgcagctcggcgatcatcttcacgccgaaccggtcccgcagatagaccatcaactcgtacgtgatgccgtaatcggcgagcacctcgttgggctcgccctcgtcccacaggttcagcgagttctgtgggccgccgcactcccgcggattcgcgttgtaggtcgtcttcacgttgccgaaaccctggtaacaggcgatgtggctgtcaaagccgggatggtgcacgccgatccgtgggtccacatagccgaccagggtctgcgcgtaatcggacagcccctcgttgagccagtccacctcggccgggtcctggtagtactccagcaggtgctgccactcgtgggcgaaggtgccctcgtacatccgcggccgcgccggccggctggtgcacaggtcgtcggtcggttcattcttcgggtccgcgccgagccggtgctgccagtcgtaggcgtcgatcgtcatcacgttccggtcgaacaactcgttgagctgcgccgagaagaagcccgcgatgtaggtggggcgttccgggaaatggaagtagttgtcgtcgcggacgttgtcgaccagcgtcacggtcttgtcgccgtcaccgctgaagtcgccggccatccccgggtgcgcgcccgaccggtccggcggcgtgctgaacgtcgccgtctccttcgggtagatgttggtgtcgaactgggtcaccagatcggcgacctgggcgtcggtcacctcggtggagttcttacggcagtcgccggccgggaaggcgatgtccttggccacccagacctcgatgtgcctgccgaccgcccgcaacgtgtagtccttgcggtacaggtcgccgtcggtgtcgtccaaccccacccagctgcggaccgtgccgaccgcgggggtggccgcgggcgcgcggcgggcggtgggttgcggccgatagcgcgcctgcggcaggaatttgccaccgagacgcaggtgtgtacgggtgaggccccggccgtcgatctccggcaggaccccggcgtgcccgtgcacggccggggtgagcggccgctgcggctgtgcctcggctgggctggtgaggagcggggccatgatcacgactgccgtgagactggcaaatccggtgcggttcacgaagcggacgttacctgcctaaaggtgcatatggcaccaacacgcgcagtcgatcatgaagcatccgccctgcacgcttcacctgtcgtcggcggccgctctccaggatcgcactccccctgccgcgtgggcccggaatcgcctcgcacggcatcggaaaccgtcgtcgagcaggaaggttcggccatcattcagccgatcgcatccgcggcgcccgcggcgtggacacggatgtgggcggttcggggacacgacggggtgtcactcgaagaggctgtgcttcctgccctgctcggcgcggttgcgggcccggcggcgcttctggatcaccaggatgtcgacggcggcgacggccgcccaggcggcgagcaaccagccgggcagagtccagccggcgcggaacaggatcgcggacagggcggcgcagaccaccatgccgaacgcggcgaggacgagccggaggttgagtgggctgtacggctcctcgacagtgccgcggcggccgggtggttgcggaccgatgggcataggcacgaatctactcgtgtcggacgggacgaaaacaactcgccccaagatcgggtagtttcgatatcttcggcgtctggcactgatccgctgtggacaggaggcgccgtggcagagacggggcttaccgagcagaactcgcgcaaactcggcacctggtccgtgttcgtcatcgcggtctccgcgatgacgccactcaccgtcgtggccggggcgctacccctcgggtacggggaagtgaaagagaagggcatccccgtcgcgtacgtgctggtcgccgttgtcctggcgatcttcacggtcgggctcaccgcgatggcgcgccacgtgccgaacagcggtgccttctacgcctacgccgcgaagggcctgacccggccggccggcgtcggcaccgcgttcatcgcgttgctcgcctacaacgccatgcagatcggtctgtacggggcattcggtgtcgccgcgcacaacgccgccgcgatcttcgggctgaagatgtcgtggatcgtctgggcgctgctgggctgggcggtcgtcagcgtcctggggttgcggcagatcgacttcaacgcccggatcctgaccgtgctggtcggcgccgaagtgttgatcgtgctgaccctggatgcggtcatggtcggtcatcccgacggcggatcggtcgcgttcgacacggtcaatccgggcctgatcgccagcgccggtggagtgtcgctgctggtcggtgcggtggccgggatggtcggcttcgagtcgccactggtctacgcggccgaggcgcgcgacccccggcgtaccgtcgcccgggcgatcttcatgacgctcggcgtcgcggcgatcctctacggcggctcggcctgggcgatgtccgtcgtggccgggcccgacaagatcatcgatgtggccgcgcgatatctcaacgacctgttcttcgtgctgcccgggccatacctgccgaccgcggtcatcgacctggcccgggtcttcttcgcgaccagcctgttcgccgcgatgctggccttccatcacaccgtcgcgcggtacgcgttgactgtcgcccgggagggcgtgctgccgccggcgctcgcccgcacccgtgacgacgtgccggtagccgcctcgatcgcccagtccggcctggcgttcatcgttctggtgatcttcgcggcgctggtactgaacccgaccagtgatctgttcttcctcggcacggtctccggtggcctcggcgtgctggcgctgatgacgatcgcgtcgatcgcagtggtccgattcttccggcgtgacacgcacggtgagacgacctggcgccggtcggccgcgccgtggattgccgcggtcttcctggtcctcatgctgcttctatcggtggcgttcttcggcgagctgctggattcggacaatctggtgaaggtgtggctgccgccgatcgcgttcctcggcgtctatctgctcggcgtctggtgggggcggcgtctgcgccgggagcggccggcggtctacgccgcgatcggcaccggcctgccaccggaagccgacaggcccggcctggtcgtcccgccgcagcgcctcaacggtgtggctgccgccgcgaagccggaggccgccgcaaggctcgaaatcgctgacgcggcccccgcgaccgtcggcctcggcgcaacccccggcccggcaaccccgaacccggcgacgacggtcacgccggatgtgacctcccagcccgaggcggccggcaagtcgccaacggccgagccggacgtagtcggccggtcggcagcggtgggaactccggcttcggggctggagccggatgcggccggccgcaccatggcggcgggcatgccggtgacgggggccaagcctggtgtgaccacgcggacggaggcgctcggggaggcggcggcgggtgcgcctgcggatgtggtcgcgcggacggaggcgctcggggaggcggcggcgggtgcgcctgcggatgtggtcgcgcggacggaggcggttcggggtgcggcgggtgacccggtggagatttcggctggggaggcggacggtggcccggcggatgttgtggccggggaggcggcggggtggcggaccgagcgggcgcggccggcggggacggacggcggtggagtgaccaagccgacagtgggtggatcggagccggaagaaggcggaaatccgccggtcagttaactatgggtgacggacggtatgtcatggggcctgcttgtcgctcctgcccgtctcatcgctaaggtcgttgtcgatgggttcaccccggccactggactccccgctgaataaccgtatgatcttcacgttcatgcgggccacaccgctgaacatccggtagttgtcgtgaagcccaagaagttttacggcaataccccggctgatccgccggtgctccggcatccgaacccacccgtcgggtgccggcggatccgcgaacttcggccctcaccatgggctggcgcctgggcggcgcgtacgcacgccgcccaggatggtcactctcggttatctggcggctcggtcggtggagctcgccggccgcttccgaagccgcttcgtcacggcgtccgccgatccctccggtgtctgagcccggtgtctgagcccgaggacccgcaggggtgtgtggccgcggatcgtggcggtgtttgagcccggtgtctgagcccggtgactgtcgccaggctcgccgatccatccgatgctcgaggcccgggctaccacgagggcgcccgcctacctgatgtccgaggaacgcccgtgcctccaagcttcggggagggcgagccttggtccgagctggatgggccgcagcttcgggggaggtgggccgcggcttcggggaaggtgggccgcggcttcgggggaggtgggccgcggctcagggggaggcgggccgcgtttcgagggaggcggggctcggctcagagtggggtgctccggtccggcgttcgtgggtgggaccggcgcggatgggtggggtcagagatcggcggtggcgtgctgttctgcctcgcggaggactcggaggacgttgtggtgggccagcttcctcaggtcggtgcgggaccagtcgcgggactccagctcggtgagcaggaccgggtaggcggcgacgtcggggaggtcgatcgggacgtccggggttccgtcgaaatcgccgcccaggccgatgtgatctatgccggctacagcgcgggcgtggtccacgtggtcggcgacctcggcggcggtggcgtccgggcgggggtgggcggccagccaggggaggaaggcgggttcggaagtcatgtccgcgatggtggccgtgggcggatcggactcgccggcgcgaggggcccggggccaggtgtcctgcaccgggggcaggcccagacgctgccactcctcgtccgccgcgcgctgccaatccaggacggcaggagagacgaaacaggctacgaacggaatctgcaccacaccgccgttggccggcaggcgctccagcacgtcgtcggcgacgttgcggggatggtcggtcaccgtacgggcgccggaatggctgaagatgacaggggcggtggcctcgtccagcgcggcgtgcatggtgaccggagccacgtgcgacaggtcgaccagaacaccgatccgctgcatctcgcgtaccagagcccgcccctcggccgtcaggccgcctgacaccggcggcgccgcagccgaatccgcccacgccgtgtgatggttgtgggtcagcgtgacatagcggacgccgagccgcgccagggaccgcaacacgccgggcgaacgcgccagacaatgcccgccctcgacaccgatcagcgacgcgatccggccggccgcgacaatccgctccacgtcgtcagccgtgcgcgccgcctccagcgtgtccggatactcggccagcagccgatacacgacgtcgatctgctccagcgtatgcgtcaccgcctccggctccggcagcgacgacggcacgtagaccgaccagaactgggcgccgacccggcccgcacgcaaccggggcagatcggtgtgcaactccggacgtgaaccgtcgagacccgccgtgctcgacccgtgccacccgcgcaggcgcatagccagatcattgtgcccatcgaagatccacattcctcctggctacccggaccggcgcccggaagcaagcaggcgaggccgattccggcgagccgggagccgcaaccggcccgcaccggcacgggcactcggcgcgcacccggcgtcccggaatctctttcacatgcccggcgggcaacaccgctggacagactcggggggaaagccaatcttgatgcgttcgacgctgcgcaagaccgtactgacgctgaccgctctcgtcgccggactcggcgccgcgacggccacgccggcacaggccgctacgcacgctgccgacgcgggatgtgtgaccggcgccaagctggtcccgacctgtggcgttctgtggggaggcgcggccggtggcttcaccagcgcgccccgggacaaggcgctgaaagactgggagaacgccagcggccggaccgcgacgatcttccaccagtaccacaagggcaacgagccgtttccgaccaaggctgagatcgcgatgaccgccgacagcgcgcacccgcgggtgctgctggagaactggaagatcgcgtacggcaccacctgggccgccgtggcccgaggcgggcaggacaagcgcatcgacgccttcgcggcgcgggccaaggcgtacggcaagaaattcttcctggttctgaaccacgaaccggagaacgacgtcatcccgcggtccggctccggcatgcaggccaaggacttcgcggccatgtaccggcacaccatcgagcggctgcgcgcgcagggcgtgaccaacgtgatcaacgtggtcgcctacatgggcaacgagaagtggatggcgcagtcgtggtggaccgacctgtaccccggtgacgacgtcgtcgactgggtcggcctggactcctacgtctccgtggagaagggttactaccactacggcgacttctccgcgctgctggaccgcaaggccaagggtggcacgctcggctggtacgactgggccaccaccaggcacgccgacaagccggtcatggtcgccgagtggggcgcgtaccaccgggtcggccgggccaccgacaagtcgttcgtctacaacagcgtgatcgaccagctccagaagcgtccggcgatcaaggcgatcgtgcacttcgacaccaagcacgacgacgagggcgaccgcgacatcagcatcaacagctcggcggcgtcgctgaaggcgttccgcaagctggccgccaacccgatcttcgacgtgaagctcggctgaatctttactcaccccctgaggaaacgccgtccgggtcccccgcccgggcggcgtttccgtatttcgggcgaaaaagtgggttcatggagcaggcgccttgccgccttgatcagacgggtggtgccggaacgggcggcgacctcggccaggcccggaatcggggagcggtctggtatcggcgtgcggtccggaatcggggcgcggtccattaccggcgtgtggtccggaatcgggcgctgaccatgccgggaattgcgaacaggggtacgacgatgtcagccgcgccggcgcagcaacctgatcgatcccctcgcgagcagggccgcggccagcagcgcctggatcgccagcaggtgtgcgaccaggccggggaccgagacgtcgccccatcggcggccggcccagacgtccgcggcgaccgcgccggcgccggtcatcgcggccagcgccaacagcgggagcacgctgctgaggttccacggctcgacggaccgcggcgggcttaccggctcggtggccgggtgcagctggccagccggttgtccgatcaggaccagttcggtccggttggcggcgtagtgctggatcgtcgcggcgacgaatccggtggcgatgccgtcgacccggaaccggtgcgggttgaccacccaaccggtggtgcggaccaggtcgggccgggtgtaccggagccggacctcgaacggtccgctccagacccggcgcgggtcgacggcttcccacggaatggtcaccgagccggtgtgtttgtcggcgtgcaggccgtgcggggtgagcgtgaggccgatcccgtggcggatggcccgagcgcagcaggccagcgtcagcacgccgaaggcgccggcgccccagaacaccggacgggcctgcccggcctcggcgggggccaccacggcggcgcccgccaggcccagcatggcgacggccagcagcgggaacgtgccggggcgcggtgtgtggaaggcgccgtcgacgatcagcgcggggcgctgcgagccggtccgctgcgcggcggccatgacggcgagggcgagcacggcggtgacgcccgcgacggcgaccagcgccagcgtcgccacggtgggcccgatcggggcggggctcagccggcctgcggccaccgtcgccacggtgaggacggcggagtacagcaccagcggcaggcgcagccggtaggcggccgcggagatctcggcgagcatcggtcagatccgggcccgggcccggaaaccgcggatcgcgtcgatgagcaccgcgccgatcgcgatcgcggccaccgcggcgagaacgtggacggattctcgggccgtggcgtcgtcggcgtggccgagccggcgggcggcgaccgccagcatcgtccacacgagggcgaacagcacgatcggccgccgatggcgatcgacggccgtgtccagtctcatgatcaccgcgggagtgtagagcgggcccggtgaccggacggtcaccgggcccgccggtcgttcaggacaggtcgtagacggtgctgccgccgaccgtggtcgccgggtagttcgcggtcacccaggaggcgatctgcgacgagtcggtcgaaccgccgcccatccccccgccgccacccacgccgccggcgatgtagtaatggatccggccggacttcacgtacgtctggaactcggcgagggtgggggagggatcgctgccgttccagccgcccagtgcgatcaccgaggtacccgaggccagctccaggtcggcggccgaggtcgcgccactgaccgcggccgaccacgtggtggtgctcgccttgagcagggcggtcagctcggtgtcggcgccaccaccccggcccatgcccccgcccccggggaagggcgcagacggcgaggcggacgcggtggaggaggacgcggacggggagggctgggcgggggcattgcccgcgggcggcgccccgtcacccgtacggccgaatccgccgccgcccggaccaccgcccatcccggagcttccggacggtccggagctgggaatggagcccgtatgggcgacgccgaccgtggcggtcgcgtaagccgcgctgccgagcccggccgacagcagccccgcgacgatgccgatcacggcgagccggcgcagcgcgacggccggcacgatcagcccggcggccgcgaccaccccggcgacgaccgccgcccagcgcagcgccggcagccagtcggtgcggccgagcagcacgaagccccacgcggcggtggccagcaccatcgccgccagcacgatccggccccacagccgggtgcggtagagccagagcacccgggcgccgattccggtcaccgccgcgatcgacggtgcgagggcgatcgtgtagtacgggtggatggtgccgctcatgtacgagaacgtcaccccggtcaccagcagccagccaccccagagcagcatcgcggcgcgcgcccggtcggtgcgcggtgcggtccaggtcgccgcgagcacggtgaccagcgcgatcagcgcggctggcagcagccaggagatctcggtacccatcgacgtgccgaacagccgcccgatgccggtcgccccgccgaacccgacgttacccccgccgcccccgcctccgccgccgttgcccgcgccgccgaggatccgaccgagaccgttgtagccgagggcgagttcccacagcgtgttgttggtggaaccggcgatgtagggccgcgacgacgccggccagagggagacgagcgccacgaaccagcccgccgaggcgaccagggcgaggccggccagcgacagatgtctgaagcgcctgcccagcggcgccggggcggccaccagatagaccagcgccatcgccggcagcaccaggaaggcctgcatcatcttggtcagaaagccgaagcccagcagcacgccggtccaggccagcgacttcccgctggccacctcggtggcccgcacggtggtgtacgcggcggccgtcatcagcagcaccagcagggcgtccgggttgtcgtaccggaacatcagcaccgccaccggggtgagagccagggccgccccggccagcagtcccgccccgtgcccgaaccagcgcttcaccgcgaggtagagcaggaagacgctggccacgcccatcagcgcctgcggcgccaggatcgcccagctgttcacgccgaagatgcgcgccgaaagtcccatcacccacatcgcggcgggaggcttgtccacggtgatcgcgttgcccgcgtccagggagccgaacaaccaggccttccagctcttcgcgccggcctgcgcggccgcggcgtagaagctgttcccccaccccgaggcgctgaggttccagaggtacaggacggccgtcgccgtcagtagcgccaccaaagaggcacgctccgggacgtttcgggcccggtggccggctgtcgtcgtcatgggactaacctcgcgggtggtgctacgacggctctgtgatcaatctgtgggccgtctatgaacccagttcgccgcgtcggccagcggtacgtgccacgatgggcgaagtgtgcgagtgtcccggtccggagtgggagagatgagcgaacacgtttccgacagtgccgagtggcaggcgctccagggctacgcggagaagttctcggcggtccacctgcgcgacctgttcgccagcgacccgcagcgtggcgagcggtatgccgcggaggtcgccggcctctacgtcgactacagcaagaacctggtcaccgacgaggtgctgagcgcgctgttcgcgctggccggccgggcgaaactgaatgagcggatcgccgcgatgttcgccggcgagcacatcaacgtcaccgaggaccgtgccgtgctgcacaccgcgctgcggctgccgcgcgacgcgacgctggtggtcgacgggcaggacgtggtcgccgacgtgcacgaggtcctcgaccggatgggcgcgttcgccgacaaggtgcgctccggtgagtgggtcgggcacaccggccagcggatcaggaccgtggtgaacatcgggatcggcgggtccgacctgggcccggtcatggcgtacgaggcgctcaaggacttctcgcagcgtgacatcgagtgccggttcgtgtccaacatcgacccgaccgacctgtacgagaagacgcgcgacctcgaccccgcctcgacgctgttcatcatcgtctccaagacgttcaccacccaggagacgttgaccaacgcgcgcgaggcccggtcgtggctgctggcctcgctgagcgacgaggcggccgtcgccaagcacttcgtcgccgtcagtacgaatgctgaaaaagtcgctgatttcggtattgacaccgacaatatgttcgggttctgggactgggtgggcggccgctactcgctcccgtccgcggtcggcctgtcggtgatgatctcgatcggcaaggagcggttcgccgagatgctcgccggctaccacgccgtcgacgagcacttccggacgacgccggttgagcgcaacgtcccggccctgctcggtctgatcaacgtctggtacgacacgttcctcggcgcgcagtcgcacgccgtcctgccgtacgcgcagtacctgcaccgcttcgccgcctacctgcagcagctgaccatggagagcaacggcaagtcggtgcggctctccggcgacccggtcagcttccagaccggcgagatcttctggggcgagcccggcaccaacgggcagcacgccttctaccagctgatccaccaggggacgaagctgatcccggcggacttcatcggtttcagcgaaccgaaccacgacatcggtgagatgcacgacctgttcatgtccaacttcctggcgcagaccggcgcgctcgccttcggccggacgctggagcaggtgcaggccgagggaacgaagccggaggtcgcgccgcaccgggtgatgcagggcaaccacccgaccaccacgatcctcgccgagtcgctgacgccgggcacgttcgggcagctggtggcgctctacgagcacatcacgttcacccagggcgtgatctgggagatcaactcgttcgaccagtggggtgtcgagctcggcaaggtgatggccaaccagctcgcaccgaagctgaccgcggccgagtcgcctgccgacgacgccgactcgtcgacgaacacgctgatcaagcggtaccgggccgcgcgcggccgctgattcaagtcggaccctgcttctaggctcagtgccgtggattcgaacacggcactgagccttcgcatgaccagccttctgctggggtcggtcaccaggtcctcggttctggacatcaccgagtggttcggcgccctgcaggcgcaggatctcaacagcgtgctgtggtcactcggcgcccggctgcgcggcagcaccctgcccgagatcgtcgccgccaccgagaaccgcgacgtggtgcgcacctggccgatgcgcggcacggtgcacctcgtcccgtccgccgacgcgcactggatgctggagctgaccggcgtgcgcgcgctggccggcgcggcgaaacgccgcgagatcctgggcctggccgaggcggacgcggaccgggcggcggagatcctcggcgcggccctcgcgggtggcggccgcctcacccggtcggcctgtgtggccaccatcaatgcgggtggcgtcccggtcagcggccagctcggctaccacctgttgtggtacgcgagccagcgcggcgtcacggcgatcgccccgaacgagggttccgagcagaccttcgtgctgctcgacgagtgggcgcccacgcggaacgcgccgagccgtgaggaggcgctgggcatcctcgcccatcggtatttccgcagccacggccccaccacggcgaaggatttcgccggctggacgatgctgccgatgaaggacgcccgggccggcatcgccacggccggtctccgccgggtcgaggtcgacggcgtcgagatgtgggcggatccggccgtgctcgacgccgggccggtgcgcggctggcgcgccctgcccggcttcgacgagtacatgctgggctacaaggaccgcgcgatgatggccaccccggagatgctcaggagcatcatccccggcggcaacggcatcttccagtccactctggtccgtgacggcagggtgatggcggtgtggaaacgcacgctcggcaggaaggcggtctcgatcaccgtctcaccgctggtcgagttcaccgccggggactggatgcaggccgaggaggcgctgcagccgtatggggcttttgtcggccttccagtgactgtaaagaaacttgcttaaagcactgttaagaacccttgatatttgtgaacgtcagcgacatcattcggtggcacaggtcaccatcaccgcctgatcgcttcatcgtcgaggagttcccatgcgtgttcgccgccaggtgctggcattgatcgccggggtgggggtggcactcggcacgacggtgatctactcgaccaccggtgaagcggccgtggcctgctccgccacggtctgggcggagggggtgacctacaccgccgggcagcaggtgacctaccagtccaagctctaccaggcgctggtcacccacaccgcctacgcgggcaccgggtggaacccggccgcgacgccgacactgtggaaggagctggggggctgcagcggtggatcgacgccgacaccgaccccgtctgtgaccaccacctcgccgagcccgacgacatcaccgacgcccacacccacggcgaccggtgggaccggctgcgccaccaagggccgcccggccggcaaggtcctgcagggctactgggagaactgggacggcgcgtccaacggcgtgcaccccgggctcggctggatcccggtcaacgacacccggatcacccagcacggctacaacgtgctgatggccgccttcccggtgatccgctccgacgggacggtgctctgggagaacggcatggacgccggcgtcaaggtgcccacccccgccgagatctgcgcggccaaggcgcagggcgccaccgtgctgatgtcgatcggcggcgcggcggccggcatcgacctgagctccagcgcggtggccgacaggttcgtcgccaccatcgtgccgatcctgaaggcgaacaacttcgacggcatcgacatcgacatcgagaccggcctgtccggcagcggcagcatcagcacgctctccacctcgcaggccaacctgatccggatcatcgacggtgtgctcgcccagatgccggccaacttcggcctgaccatggcgccggagacggcgtacgtgaccggtggcagcgtcacctacggctcgatctggggctcgtacctgccgatcatcaagaagtacctggacaacggccgcctctggtggctgaacatgcagtactacaacggcagcatgtacgggtgttccggcgactcctactcggccggcaccgtgcagggcttcaccgtgcagacccagtgcctgaacaacggcatcaccatccagggcgtcaccgtcaaggtcccgtatgacaagcaggtcccggggctgcccgcccagtccggcgcgggcggcggctacatgacgccggcgttggtcagccaggcgtacaactcggtgccgtcgatcaagggcctgatgacctggtcgatcaactgggacgggtcgaagggctggaccttcggcgacaacgtcaaggccctgcagggtcgctgacctcaccgcatccctcgatcagccggtccggaccgtccccgggccggctggtccctgtccggcgccctgtgccggctggtccctgtccgggcgcccggtcggctggtccctgtccgcgcgcccggtcggctggttcctgtccgggtgcctcaggacgcgcggtatcgcaggtagacgacgccgttggcgaatcggcgctgctcggccagcttgagatccaggcgtacgccgtccggcaggaaccgggtgccgccgcccaccgcgatcggcgagacgaacagctgcacctcgtcgaccaggccggcgcggaacgcgtgcgccgccagatgtgggccgccgatgctcagatcgcggtcggcggcctccttcgccttccgcaccacctccgggtcgaagacccgctccagccgggtgcgggccgtggtcacctcggccagcgtcgtcgaatagacgaccttgtcggcggcccgccacacccgcgcatagtcgacggtcgcgggcgtcgaatccggccgggcttccgcgtcctcccagaagcgcatcacctcgtacagccggcggccgtacagatacgtcccgatcgggcgttccaggtcgttgacgaacgagtgcacctcctcgtccggtcggctccagtcgaaatttccccgctcgtcggcgatgtagccgtccagggaggtgatgccggtgcagatcagccgtgccacagcgtctccttcagcctcggggactcggcctgtccatcctggcccgagccggcccgggaagcacgcaaccggcgcggtgtggacggaattcggggcgtccgggcgatggcccgcgccgtggtccgcggttgtccacaggttcggatcggctgtttgcggcggccgctgtccggagacgacaatggcattccgggatcgacgactgcctgtcccggctagtggatcacccctgctcatgccggatgcggaggtgtctcggcgaagcggtcgacggcggatcagaaacggtcaccggagaaagaagatcaattccggaaagggtacggggatggccgatcaggaggcactcggccgcgagtatctgctgcacgaggaaatcgggcgcggggcactcgcggtcgtccggcgagccacccgccgctccggcgggccaccgctggccgctaagctgctgcaccccgagctggccagcgatcggcggatccgcgagtcgttcctgcgcgaggaggccgcgctgcgccatctcgaccatccgggcatcgtcggcttccatgacctggtcgtcgagggcggcaccctggccctgttgatggacctggtcgacggtcccgatctgcgccgccacctggcccaccgcggcggccggctgggcgccgcggagaccgccgtgatcgtcgggcaggcagccgaggcggtcgccgcggcgcaccggcgaggcgtcgtgcatctcgacctcaaaccggagaaccttctagtcgtccgcgataccggccccgccgtggtccgggtgaccgacttcgggctcgcggtgctgctgatggacgcggcgcgtggggtggccgggggcacgcccggctacaccgcgccggagatctggcagggtgcgacgccgaccgcggccgccgatgtgtactcgctcgggatcctcctggtcgagctgatcaccggtcacgtcggcggggatccggacgcactgcccgagcggctggccgggccggcccggtcctgccttgccccggatccgcgcgaccggcccgccgcggaacaggtggggggatatctgcgggcgctcgtggcctcgggtgtgctggggccgccgccaccggtcgtggcggagggcgaggcgggggatgtgcccgatccggtgtctcggcggacgacggtgcgcggggccgggagcgtcggatcgccgggggcgggaggcggcgccggcgcggccgtcgatccggagcactccgggatctgggtcgggcagctggccggtggggtgccgttgggtgggtttttggcgggggcgccgccacagggcgggtttttggccgggacaccggcgcagggtgggtttttggcgggggcgccgccacagggcaggttcctggccgggacaccggcacagggtgggcttctggccggggcgccgccacagggcgggttcctggccgggacaccggcacagggtgggcttctggccggggcgccgccgcggggtggtggcgggccgagggtcccggcggccgggctcggcgggacggggctggtcgcggaggcgccgccgaggcggcgtgaggggcgggggatgctggtcgcggccggggtgctggcggtcgtcgcggcggggatggtcggactcgggatcgccaaggtggtcggggaccggtcccatccggcggccgcggtcccggtgagcagcgccccggcggtgacaccgagcgcgggggccggcggggtgctgccgcccaccgagcaggtgcgggccagtgcgagcgccgcgccggtgcgggtcacgctcgccggatatgcggcggacgacggcgggacgctggcgttgtcgatccgggacgggacggcgatcgcgtacatctgtgacgggaacacccgggaggcctggctgcaggggaccgcggtggacgggcggctggcgctgtccggtacgggcggggcgcgaatcaccgggacgttcgacgcgctcggggcgacgggaaaggtgaccgtggccggcgggacgcatgcgttcacgctccggccggtgcagaagccgtccgggctctaccggacgtccgccaaggtgcgtggcgcgcggatccaggggtcctggatcgtcctgccggacgggcggcaggtgggggtgctgaccgacggcggccgcaccgggccggcaccgaggttcgacgtcgccggcggcaccgccacggtcgatggggtggcggtggcggtgaccgcggtcgacgtggacagcggcgcgggcttctgacgacgtggagtgcggtgcgggcttgacgacgtggagtgcggtgccggcttgacgacgtggagtgcggtgccggcttgacgacgtaggcaggtggtgccggccgctgacgaaccggtgtgacccccgccgcagcccaagttctttgaatctgaaatagtttcctcgtcaacgacgttgtgcgaggcagcccgggacgtgagtgccccggccggaggtttcaggagcgggtcatgcaattcggcatcttcagcgtcagcgacatcaccgccgaccccaccaccgggaagaccccgaccgaggcccagcggatcaaggacatcgtcaccatcgccaagcacgccgagcaggcgggcctggacgtcttcgcgctcggcgagcaccacaacgagccgttcttctcctcgtcgccgaccaccaccctcgcctacatcgccgcgcagaccacgacgctgcagctgagcaccgcgacgacgctgatcaccacgaacgacccggtgaagatcgccgaggacttcgcgatgctgcagcacctggcggacgggcgggtcgacctgatgctcgggcgcggcaacaccgggccggtctacccgtggttcggcaaggacatccgggccggcatcccgttggcgatcgagaactacgcgctgctgcaccggctgtggcgcgagcacaccgtcgactgggagggcaagttccgtacgccgctgcagtcgttcacctcgacgccgcgtccgctcgatgacgtcccgccgttcgtctggcacggttcgatccgcagtccgcagatcgccgagcaggccgcgtactacggtgacggcttcttcgccaaccacatcttctggccggcgtcgcacacccagcggatgatcgcgctgtaccgcgagcggttcgcgcactacgggcacggcgacccggaccaggccatcgtcggcctcggcggccaggtgttcatgcgcagaaacagccaggacgcggtcaacgagttccggccgtacttcgacaacgccccggtctacggccacgggccgtcactcgaagacttcacccgggagacgccgctgaccgtcggcagcccgcagcaggtgatcgagcggaccctcaagttccgcgactatgtcggtgactaccagcggcagctgttcctggtcgaccacgccggcctgccgctgaaaaccgtcctcgagcagctcgacctgctcggccaggaggtcatcccggtgctgcgcaaggagttcgcggcgctcaagccggcccacgtgccggacgcgccgacccacgccgcactggtcgccgccaagaacgccgccgaggccgccgtgaccgagaaggtggaggtgcaggcatgaagcagcgcagcctcgtcgtgatcagcgccggcctgagccagccgtcgtcgacccgcctgctcgcggaccagctgtccgcggcagcggaccgggccgccacccggatcggcgtccagctcgacatccaggtgatcgagctccgcgacctggcgcacgagatcaccgaccatctgctgaccggtttcccgccggccgctctccggcaggcgcaggatgcggtcgccgccgccgacgcgctgatcaccgtcactccggtgttcagcgcgagctacagcggcctgttcaagtcgttcttcgacgtgctcgaaaaggacgcgctggccgacaagccggtgctgctcgccgcgacggccggcaccgcccggcactcgttggtgctggagcacgcgctgcgaccgctgttcgcctacctccgcgcggtgccggtgcccaccgcggtcttcgcggccagcgacgactggggtgccaactcggtggagggcccgctgcgcggccggatcgagcgcgccgccaccgaactggcgcgcgaactcgaccggcgcgaaccggtgacggtcgtcgatccgttcgccctcaccgagtccttcgaggacatgctgaaaaccctttagttcgtacgccgtgatccgacgcgcgccggccatccccggcgcgcgtcgccgtatcgggccgagcctcagccccggcgtggggtgggcgtgggcgaggcgtgtccgtactttgatgccctcgggccggcgcgcggctggcggcgcgcggctggggcgagcggctggggcgagcggcgtacggctggtgacggggcggctggcggcgagcggttggcggcgggtgcgccgcgaatcgcaccgtgggttggccgaaagtccacatcgcggccagccgaacagtgatcggcacaacccggacagggcatcgacgaagatcacgctctactgcagggtggtgcgggtgacctatggaccgccgcagcagcagccgaacccaccgcagcccgccgcgccgaaaaaaaagcccagcggcaagctgatcctgggcatcctcgtcggggtggtgttgctctgctgcggaggcggcgtcaccgcgatcaacgccttcaccggcgactccggcagcaccaaggcgggcgggaccagcacgagcggtgcgcccgcggacgcggtcgtcgtcgcggccgccggctcgccgtccgcgggggtctcggccgcgtccagcccggcgccggtcaccgccaagccgaaaccgaccgccgcaccgaccacgagaacccccgccgcaaaaccggcgacgaccggcaccaggccggccccgccgaagacgaccagaccgaggaccaccaagccgacgaccaaagctccgaccacggccccaccgcagtcgggagtgcatccgggagcgttctgctccccggagggcgcgtacggcaccaccagcgccggcactctgatgcgctgcaccagcaagaacggcgaccgaccccgctggcgcagagcctgaccggcagcccgtggaactcgcctcggtccgcgaggaggagccggcgcgagaggtgagcggactccaccgcgaggcccggctggggcggtcagcgtgggtgggtggacggtcgaggtcaggtccgggtggggcggatcggcgcggggcctgagcgcggtgggctggcgcggggcctgagcgcggtgggctggcgtgggccctggggaggacccgccggcgcgaggtgtgagcgccgtcggtgaggcgcgggctgagcgggtgggcggcggcgggatggggcgccgggatggggcgccggggcgggttgtcccgggtggtgggtcggggggttgacacactctgcgcgtcgacaacggcacgctttgttgttcaagctgttcgggtgggcacgtccaccccggtccagccgttggcggatctcccggacggcgagccgcctgtggtccggcggcatctcgtcgtgctgccgcgcgggcgtcggccggccggcccggcccccgaggcggcgctccggcatctgatcgccatcccgcgcgaacgccccgacacgccgccggcggtcgaccggcgcacggtgccgatcgatggcggcgtccggactcggcccgcggacctcagcgtctccagcctgacgggctccggcctgacgggctccggcgcggcggcctccggcgtggcgggctccggcgtggtggcccctcggctgccggtcggtgactcgggagtctctcgcctggcggtctccgagctgacaggggcttccgggccggtccgctcgaagcggtggtcggtggtcgcggtggtggtttcggtgggaatgctggtgctgttctgcgcgggcgtggcagccgtgaccgtacggctaagtgtgcttcttgttgctctgcgtagcgattgatagtgctggccacccgcctggcgagtggccggccagtggtcgtatggtgtgcgacacaccgacggtgggcagggattctgtttcgtccgggccgtcgggtccggctgcgtggacgggtcgcggtgagggcacctggtggaggccctccgttaaccgaaggttgtgccaggaccgcctcgcaggggtggattccggcgcgcggtcgtttgcacaatgcaagtatgaggaaccggatagcggcaaaggaggcgctatgaccatgaccggcgcacggggaccggccttggcggaacggcctcgagccgacctgcccgtgacaccgctgacgtggcagcggaccgacacggtcggcaccgagctggtgttcccgcgcggttcgcggccacacggctcggcgatcgtggcgggcgcacgggcgtactcgctgacctggcaggcggaggtcacgtcgacgtccgaggtgacgtcgctgcatgtcacgtcgcagggcgacgggtggagccgggagctgtggctggaccgcggcgcgagcgggtggacctgccgggcggaacacgccggggatgccggtgacctgccgtccgccggtgccgagcagcgggacgcgctcgacccgcgggcggttctgcgcctcgccgactcgccgatcttcgtcgcctgggcggtgcgtggcctcggcctgacggtgaagtccggcccggtcaccgtcccggcgatccgggtgcaggtgccctcgctggcggtgctgcccggcacggtcacctaccacctggtcagcccgcagcgcctgcggatcaccggcgactggccggcgtccaccttcgagctcgacgctgccggcatggcggtctaccaggccggtcacctccgcctggcccgctgaagcaccggcacccacgcgggtgcctcgtcgacgcgcacggtggtgtcccggtgcgggacaccaccgcggagaactgtgactggcagcggtagttgcacttggacagtcatggttattcggctcggttgtggtcgtcggcatgccgcaggcgtgacgcgtcttgacggtcagggttaggctgccgctccatgatcaggtcggcgaggttgacggcgcttccagccgtcgcggtaggtggggcggcgctgtgggcgtacggcatcgcagtgctgcaaccgctcaccgagccggactcccgttggtgggagatggcacagaactcgtcgtactgggctcgtgacctgcggtggggcgcaatcgtggcgtcgtgtctcgccctcatcgtgctggctggtggcgctcggtggcccacgcgtggggtggctgccggtggcgtcggctggatcgtggtggatctgctgatggaccgcgccgacccgggccgacccgcactgccactcacactgggcgtcggtgtccttgtggtggccacggccgccgtcgtctgcacgcgatgtgggcgccgcacctcactgagacctccggtgttgcgtaccgtcgcagtgatcggcgtgctgagtgcgatcagtatgctcggcgtgggttcgccgagcggcggcgagccgcagctgccgccgacccggctggccgtggtgctgctgcacatcgtgctcgcttggatcgcgaccctgactgcggcagcaccggttgccgcgagtcgggctgcggcgacgacgggagtggcgctggggtgggtggtgctgacggtcttctttgcgcacagtcctccagatgctctggtttggctactcctcgcggggtcgggcctgtttgtcgccgggatctggtcggtgggccatccgtccgcacccgccggcttgagggccgcggtcacgatttcgggcgcgctgatcatcccgatcatgtgcatggtgatcggctacgcgacgatcatcatcgggccggacatgacgcggatggcgggcaacgagtctctcaacggggacgaggacatgctcctcggcttggccggggtgctggcaggattggccgtggcctggtgtgggcgcgcggtcagcaggttgttcgccatgtcaccgcagggttgccggtccgcggaagcggggcccgatgacggcggcgttcaggtgacactgaccctgcccgtcggtgacacgtagcgctgtcggttcgggcttcccggaacgaacgttcggtttggtgggtaggctgggcgggtgccgcgtgtgtccgaagcccacctcgccgcccgccgtcagcagatcctcgatgcggcggtgcgttgtttcgtgcggaacgggttccatcagacgtcgatgcaggatgtgatcaaggaagcggatctgtcggtcggcgcgttctaccgctacttcaagagcaagaacgagctgatcatggcgatcgccggcatcaagatcggcgaggtcaccgggattctggacaacctgctcgcggcggatcccatgccgccgctcccggccttcctggacgcggtgatcggacaggtggaggcgaccctgcaggccgaccagacggtgcggatcgcgatccagatctggggtgaggccacctacgacgacgaggtcgccgaggtggtgcgcgacgtctaccgccggatcagggaacggatggtgcggaccgccgagcgcgccagggccaccggacagctgccgccgggcgcggatgccaccgctgtcggtgcggccatcttcgggctggtgcagggttacatcctgcagcggatcctggtcggtcaggtcgaccgcgagacgtatgtcgccggcgtccgggccctgatgaccccggcctgatcgaccggtcgacggacgggatccggccggcccgccgccgacatggggtacaccgtccggtggcaaggactcgcaaggggccgctgtgcgggcggtggcaagggcgggagacacgcggtgacagcggcccggataccggcgcggtaaggggcgggaaggcaagaggccggaaggcggggagcgggctcaggccggcgggatcaggcggcggatggctgctgtcaggcccggagcgtccagctcggtctcggtgaccagggcgcgcaggatgatgccgtccagcagggcgcagatgtcgcgcgccgcgggctcgccgacccacgggtggaggatctcggggagtccgtccatccaggtttcggcgagtgcccgcagccgggcgtcgcgcgcggcggccatgcacagctcgtactcgatgcggacctgccgccggtcctgcaggtattccgcggtcagtgcggtcagctcggccggcatgtccggtgcggccgcgaggcgggtggaccacacgtccaggtcggcccgcatcgcgtcgcacgagtaccgcaggccggcggcgatcaggtcgtcgagagtggggaagtagtaggtcgtcgcgccgagcgggagtccggcccgggcggcgacggcgcggtgggtggtccgtccgacccccgcctcggcgatgatctccatggtggcggcggccagggcggcgcggcgcgcttccggatcgcggggacgctgcggccggcgctccgcagcggcccgggtctccgggtcgcgggattccaagccggcccgggtctccgggtcgcggggttccaagccggcccgggtctccgggtcgcggggttccaaagcggcccgggttcccgggtcgcggggctccgaggcggcgcggctttccgtggggcgggggcggcgctcggtcaatgcgcttccgcgccggtcaggttgagcatcacgactccggcaatgatcagggtgatgccgcccaccttagcgagggtgaccggctcgtcgaggaacaaggccccgatcaccacgatggccgcggtgccgaccgcggaccagatggcgtaggcgatgccgacctggatgccgcccttgatcgcctgggagagggccacgaaggacactccgtacccggcgaggacgacgagggtgggccagagccgggagaacccgtcggtggctttcatcatgctggtggcgaagagttcgctgccgatggcgacggcgaggaggacgtaccgcactgctatgcacctcatcttgtacgttcgtacaagtacgatcgtacaagaaaccctcgcccctcggaagggagaggattcagggttgatcaaccgggtaaggggatggggaggttttccaccggattcaggaggttctgatgaccgcagtcgcgaacccggccaccgttgaggaatgtctgcgggtgggcgccggcttcacccagggtgaccggaactggatcgccgagcagttcggcccgctcgacgcccgtctcgccgcgttccacgccgacgccaccgagctggagatcacggtgaaggaccgcgaggcgcgcggccagaaggtgaccctggagtgctggatcggcggccgggagaagatcgtcaccacgtcctcggaggaggacctgcacgccgcgatcatggacgtccgcgacgacctgcggcgccggctcaacgacgcgaagaccaagcaggagccgcgccacaaccggcacctgcgggaggtccccgaggtcgtcgtggacgaagacccgatctagagacgcttgccgaggtacgtcaacggccccgggtcagggaccggaagcaccgtgaatcccatccggtcgtagaacggccgagcgcgaacattctcggtcaccatgccgaggtgcaccccggtcgcgccggcccgggccgccgccgcgctgagcgcgtcgatcagctgccgcccatacccccgtcgctggtagggcggcagcaggtcgatgtgcaggtgcgcggggtggtcggccagctccggcacgatcatccgctccggccggtagtgcagcgccaccatgtcctgctcgggcgtgcgcggcgggggcggcggcaccggatacctgccggccagccgcgggatccactcctcgcggtagcgtctgacgaacgacgcggtgtccgcggtccccaccacatagccgaccgcccggccgccgtcgtccagcacgaacgccagatccggttccaggacggcgtacgggccggcgaacaggtcgcccatcagcgcgtcggtggagtacttcccgcgggcgtcgccgccgaggtcggcggtgcgcacacagatgtcgtagagggcgggcaggtcggccggccggtagggtcgcatctcgggcacgcctgcaggctaggccgtggaagcgcttccaccgcaagtctcccggaacaccggaacgctggggaacaacgtcgccggggcgggttcgcccagcgcggcccgggccgcggccaccgcgatctcctcgaccggatgggtcgcggtggacagcgccggatgggtcgccccggccagcgggacatcgtcgaaaccggtcaccgcgacgtcgtccggcacccgccgcccggccgccgcgagggcctgcagcacgcccagcgcggtcgcgtcgctgaccgcggcgatcgcgtcggtgtccggccagcggtccaggatgccgcgcgccgcggcacgaccgccgtcgctggtgaagtcgccccgcacgatccgcgcgggcagcccggccgaccgggtcagctcggcgtaggcggcgaccggcgcggcggacgcggcgagccacgcggggccggcgatcagggcgatgcggcggcggccacccgcgtacaaccgcgacaacaacgcgccgacgcccgccgcgctgtcgacatcggccccgcccgtgccgatcgcggccgtccggccgcgcaggccgggcggcaggttcgccagcatcacgcggtcgtgcccggccaacaccagcgcggccaggccgcgatcgtccgacatcaggcgcaggtccgcggcggcgcccaggccgatgcggcgcagggtgagtccgatgtcgtacgtgtccagcaccgccgccatggccgccgccgcccggatcacgaacgggtcgcgcaggatgtcggcccgctcgtcgcgcaccgcgaagaccagccgcgtcccggtgccgcgggccagttgccgcgccaccgggtgcggctgatagcccagcgtcgcggcggccgcccggaccgcggcgcgactgtccgccgaggcgggcccggacccggacaacacccgcgacgcggtggccggcgacaccccggcgagacgggcgacgtcggcgagtccatgagacacgctcccagtaaacctcgggactccggttccgggtgcgccgccgcggcacgccaccccggacgagctggcaacgccgagcgggcgggtgcggcaccgaggttcggcgagtgcgacctggcgctgtggccgttcagctggctggtgcacgtgtggtcggcgccgctcgcccgctcctggcggccgtacgtcgtccgccgcgccccgccggccccggccgtgatccgggactcgcgccggagagtatagggtcggtccatgacgacgctcgacgggcgggacgccacggcactgctggtcatcgacgtgcagaacggggtggtgggcgagacctcggtcaaccgggacacggtgatcgccaacatcgccaccctggtcggcaaggcgcgcgccgaggcggtgccggtgatctgggtgcagcactccgacgacgacctgccgttcggcagcgagcagtgggcctacgtgccggagctgccccaggccggcggggagccggtggtgcacaagaggttcggcgactccttcgaggcgaccgacctggaggagcggctcgccgaacgcggtgtcggccggctcgtggtggccggtgcgcagtccgacgcgtgcatccggtcgaccatccacggcgccttcacccggggctacgacgtgctgctggtcagcgacgcgcacaccaccgaggacctgaccgagtggggcgcgcccgacccggcgaccgtggtgtcgttcaccaacctgtactggagcgggcaggccgcacccggccgggtcgccggcaccgcgccgaccgccgaggtcgacttcgccggggccgccgcgtgaccggtggcaacgagtggctgcgccggagcgccgaggatcccgggcactcacagtggtacatcaagcggttccgggacatggcggcccaaggcgccgatctggccggtgaggcccggctggtcgacaccctggtgccgcggggcgcgcggatcctggacgccgggtgcgggccggggcgggtcggcgggttcctggcgagcctgggtcacgacgtgaccggggtggacctcgacccggagctgatcgaggcggcgatcgccgatcaccccgggccgcagtggctggtgggtgacctgtccgagctgaagctgccgggggtgccgttcgacgcgatcgtctgcgcggggaacgtgatgaccttcgcggcgccggacacccgggtggagatcatccgacggttcggcgagcacctggcgccttccgggcgggtggcggtcgggttcggggccggccgcggctatccgttcgacgaattcctggccgacgtgaccactgccggcctcgccgctgacctgctgctgagcacgtgggatctgcgcccgttcacgccctcggcccagttcctggtcgcgctgctccgccacccttaggccgcgccacgtcagctgtcgcggccggggggaaggcagttgcgcggcgcgtcccagccgagtagtccggtcgcctgctcgagccgctcgcccacggtgaggccaccctgatcggcgatgtggcagcggtacatggcgttgtcatggcggctgttgcgcatcttgacgacgttgaggaagcggccggccgcggcgcattcctcgatgtagcgcacctggatgacgttgtggaacagatacatcagaccggtgagcggatcatcgacgtggccgaacagctgcgtctcgctggtcacccagagtgaggcgccggcggaccggacgacggcgagcatgctgcgcaggtatgcgggaaaccgctgggcctcgcgggcggcgtgggccatctcggcgagactgtcgatgaccacccgccggaccgatccgtcgtcgaagctgtgccgaatcatcgacgagagcacgtccagatcgagatcgagcgcgccgaccgggacgtgggcgatgaccagctgatcccgttcctcggcggcggcgaagtcccagccgaaccggccggccatctccttcagctcctcgacggtgtcctggaaggtgacgtagaggcaccgctggccctgcgcgaggccctcggcgagaaagctgagacagccgatggtcttgccgactccggtcgggccgagtacgacggtgccgtccccgtcgggaatgccgccgcccatcaggtcgtccaagccgggaataccggacgatatccgcgcaccgcggcccggcatgtcggtgggcaggaaggactcgatgcgcgggtagacgcggataccgtcgtcggtgatgtgcagggtgtgggcgccaccgagcggtgcggcgccgcgcatcttgatgacgcgcagagtgcgccggtcgaccggctcccggatctggtgggagagcgcgatgatgccgtcggccagagtgaattcgatgcccgactgcatgtccgcgtcgctgtactcgccaagcagcagcaggacggctccgctgtgggcgacgcggctggtcaagtcgtacagggaggtgcgcaaggcccgatcgctgacgaagtcgcgcagcatcatggtgctgtcgacgaccagcaacgccggctcgtcgtcgagcgccttgcggaccacctcgtcgatgaccgggtccaggccggccgcctggtgcccacgcagcatgtcgccgaggtgcacgtactcgacccgcgggcccagcgagcccgcgtcgaagaaggtgaagtcgtgaaggtgttcgacgagtttggcgtgcggctccgacagggtggtgtagtagatggccttgtgctcaccggtggccacggcgaaacagatctgttgcgccaggacggtcttgccggtgccgggcggaccggccaggacgacgaccgatccgcgtcgcaggccgccgcccagaatcaggtcgaggtcagggtgcccggtgctcaggtgtgtcaccgccggtcacttccttcccggagaagacgttcggctgcctcgaccagatcggcccgtccgtagggtttggcgagagcggcgtctgcttcgacggcgagatgccagtccgagctggccgccaagatcgggatgcccgcggtgaccgggtcggcacgtaaccggcgaatgagctccacaccgttcatgaccggcatcatcatgtcggtcaccacgaggtccggccggacctgtcgaaccgcctccaacgcgtcggcgccgttgcccgcggcgatgacctgatggccggctcgcgtgagaatccgtttggccaggaaacgcaggtccggttcgtcgtcgacgaccaagatcgtgcccaccggttccgtcccgctgctggatgtctcacggtgaccgtaccgatgatcggtgccgctgtgacgagaagtgctgtttcgctcacgtccgccttcacgatctggtcgccatggccgaggctcggccacctcccaggcgttgcgccacggtcggattcgcggtcaacttctgggcctgggcgctgctcagcccgctcgccgttcctcggcctggccgggcacagctcgctcacgcttccagtcgtacgcgtggggcttcgtcctgctcggcatggtggccccggcggcgctgctgctggacgtgttcgcggtcaggcgccccgccaccgcccgggcctgacgcctcatcacccctcgaaggcatgctggagtccactccggcaggctttgcgcatgtcaccggacgaccggcaggtcgcgagcggccccgcgctgaccagggcccacgccgcgccgcaccacgtcgaggacccgggacggatcggcggagcaactcaacctgaccgagccatggtgtcctttcaccgccacccggtgttcctcgcccgggaggcgctggttgacggctggtccacggctgtcagtggaggtgccaggcgcgctgtcgggtgcggtcgcaggctatgtggtaggagagttcgaagcggtggaccgggttggcgtggtaccagcgaagggcctgcaggaccagggccgggtcggtgtccagccagggcacctggatggtcaggtgcggctgtcccccggtggtgggggcggcgatgatcgggatgtgggcctgttcgccgggcaggatgtcgctgatcgactcccagggcaggaagcgctggtgccggatgccgtggtggtggaccccgtccggggtgagggtgagccggcccggggcgtgccgtgacagcatgaccagcgcggcgccgctgagcagggctcccgcggcgaacggccacaccgtgaccgccaggccgagttgggcgatggtcagcagtccgaggaagccgccgtaccagtagtagagccgccccgagtaccggaaggtcaggccggggctgccgtcgccggcggcggcgatccgcatccggtcgccggtgttgtacggccgcacccacaggtgcagcagcagcccggacaggtgcccgagcacgagcgtcgcgatcgtgcaggcgaccgccgccgccccttcgccgagcagcagcgaccacccgccggccgccgcgacgagaacggtgagcaggccgctgccgaccgccgtgtgcaccagtcgcggtgacgggcggtagtcacgccacggggtcggatcggccgcgacgggtgtggtgcgcggcaggtcgaagtagagggtcatgaggctgtccggtcgttgaggcggtcaccgggggtcatcgggcgtgccgaatccgacgcgccaggggcaggctcggtgtgccggtgctgagcggcggttgcggccggtccggtccggcgggccggcgggcggtgtcgttggcgcgccggaggcgctccgtgatcgcggtgaggatgtccagatcgatcttcataggtgcccctaatcccgtcccccgagactgtcgcacgggggtacgagaccaccaccccgttcagttcaaacgcagagtagtcgtccgtgcagcatgtgcacatcggcctgaatcgatcctgcaccgggatttgacgcaccgagcgacgacccggcatccgctcttgacatcgcaaacttaagccacttaataatgggcgccgtcaccgcatgctcgaagatcgaggtatctaccgatgttgaactccttgagccgtcgagccgcggtcgccgcggccgccgtgctggccctcgcggccgccggctgctcgggcgacagcggcaccagatccaccggcggcaacgccgggaccagcgccatcaccattttcaacgggtccaccggcacgatcgtcgagaactggaacccgttcacgccgaccttcctgcagcccaccaacggcctcatctacgagccgctgtactggtacaacttcgccgccgagtcgaagccgacgccgatgctggccaccggctactcctgggacaccgccggcagcgctctgacgatcaccacccgggacggcgtcaagtggtccgacgggcaggcgttctcggccagggacgtggcgtacacgttcgagctgatccggcagaacaaggcgctcaactccaccggcgtcaagctcgcctcggcggtcgccaaggacgacaggaccgcggtgctgaccttcgagaagccgtcgttcaccgacgaggccgcggtcatcgcgaacaccccgatcatcgccgagcacgtgtggagcaggatctccgacccggccaagacgatcaacccgaacccggtcgggaccggcccgtacaagctcaagaccttctccgcgcagagctacgtgatggagaagaacccgtactactggcagcccggcaagccgcagatccagaacgtccgctacatcgcgctggccaccgcggacgccgcgagcgccgcactgaccgccggccaggtcgactggatgagcgccttcctgcccggcctcgaccagctgctgaagaaccagaagaacctcagctacgtcaacaccccggcgatgaccacctcgatcttcacctgcgccggcgccgcgctgggctgcaagggaccgcagaccgacccggcggtgcgccaggcgatctactgggcgctcaaccgcgaccagctgaacaagctggccgggggcggcttcgcggagaccgcgtcgccgaccatgctgctgccgcagcgggacaggagctggatcgccgatcaggccgatgccaccgtgccgggcgcgccggacaccgcgaaggccgagcagctgctggacgcggccggctgggccaagggttccgacgggatccgcgccaagggcggccagaagctgtcgctgaccatccagacggtgaccggctggagtgactacatctcgctgaacgacgcgatgacccaggaactcaaggagatcggcatcgagctcaagccgacccagctgtcctggaacgagtggaacaacaaccaggtgcagggcaagttcgagctgtcgttggactcgatcggcctcggcgcgtcgccgaacccgtacgccacctacctgaagtactccagcaagaccaccgagaaggtcggcgagtcggcgccgccgagcggcaactacgcgcggtactcgaacccgaaggtggacgcggcggtcgacgcggcggcggccaccaacgacgaggcgacccagaaggcgcagtacgcgatcgtgcaggccgagatcgtcaaggacctgccgtacatccccatctacgtcaactcgatgctcaccgagttcaacaccagccacgccaccggctggccgtccaacgacaacaagtacgccctgcccgcctcctggaaacagtgggacaacggcatcgtgctgaccaacctgcagccggcgaagtagacgaaggtgcgccatctgcttcgcaaactggggttctacctggtcgccctcggggcggcgctgacggtgaacttcttcgtcccgcgcctgatgcccggcgacccggtcgacatcctgttgtcgaagctgggtcagcgcggcccggtcacccccgagatgcgcgcctcggtcgaggcgatgctcggcaccgacagcggcagaccgctgtggggccagtatctgcggtatctcgggaacctggcacacggagatctgggcgtctcggtgacgttctaccccgcgtcggtcggctcgatcatcgagcagaccctgccctggacgatcggcctgatcggtctcgccacggtgatctcgttcctggccggcgtcggtctcggcaccgtcgccggctggagacggggatcctggctggacaacctcgtcccggtcaccaccatgttccagtccgtgccgtacttctggctggcgctgatcctgctcttcgtcttcggcagcatctggccgctgttcccgctcaacggcggctacgacgtctacaccgtcacgcccggctggaacgccgcgttcgccggctcggtcgtctactacggcgcgttgccggcgatcaccatcatcctgtcctcggtgggtggctggatgctcggtatgcgcaacatgatggtgtccacgctgagcgaggactacatggtcaccgcggaggcgaaggggctgcgaccgggccggatgatgcggcgctacgcggcccgcaacgccatcctgccgtcggtctccggcttcgcgatctcgctcgggttcgtggtggccggctcgatcgtcaccgaggcggtcttctcctatcccggcatcggcaacgcgctgctgcaggcggtcggcagcaacgactacgccctcatgcagggcatcttcctggtcatcacgctgtccgtgctcggcgcgaacctgctggtcgacctcctgtactcggtcatcgatccgcgcacccgcgcccgggcctgagaggggcgaccatgacgatgaccacggaactcgccgagccgaccatccctcaagatcaaagtccgattgaagtacgccgattcacgcgcaaccggaagctcatcgcgggcctgaccctcggtggcgccatcgtctcgttcggtctgctcggcccgatcttctgccaggacccgtccctggtgcacgaccagggcctgaccggacccggcgccgagcactggctgggcaccacgcagaccggtcaggacgtcctcgcccagctcgcctacggcacccgcggctcgctggcggtcggcgcgatcgtcggtgtgctgacgctgatcctgtccaccttcttcggcgtcgtcggcgcctacgccggcggctgggtcgacgacctgttctccctgttcaccaacgtggtgctggtcatccccggcctgccgctggtgatcgtgatctccagctacgtcccggacaagagcatctggctggtctccctggtgctggcgatcaccagctgggccgggtcggcccgggtgctgcgcggctacacgctgagcctgcgcaaccgcgactacgtgctggccgctcgggtcgccggggagaaacgctggcgggtgctggccgtcgagatcctgcccaacctgatcccgctgctcgcctcccaggtgatcttcgcggtcatcttcgcgatcctcggcgaggccggtctgtcctacctgggtctcggcgccagcggctcgttcacctggggcaccatgctctactacgcgcagaacggcctggccctgcggctcggcgcctggtggtggttcgtgccgccgggtctgatgctggccctgttcggcgccgccctctcgctgatcaacttctcgatcgacgaggtgatcgaccccaggctgcgcaaccggacccgggccgcccgcaagagctggcggatgtcgtccgagcagctgtccaaggcgaaggaggccacgctgtgacggtcctgagcatcgagaacttcagcgtggactatctcgtcgacccggtcgtgcacgccgtgaagaacgtcagcctcgaccttcagcggggcgaagtgctgggcctggcgggggagagcggctgcggcaagagcacattggcgtacggcatcatccgcctcctgaaaccgcccgcaatgatcacttccggccgggcggtgttccgctcccgtgcgggttgcgagaccgactggaacgccctggacgccgaagagctgcgggcgaaccggtgggagaagatctcgatggtcttccagggagcgatgaactcgctcaatccggtgatctcgatccgcgaccagttcgaggacgtcttcaccacccaccggcccgggatgggccgtagggagcgccggcagcgctgcgccgacctgctggaacgcgtcggcgtcgacccggcgcggctcacctcctacccgcacgaactgtccgggggcatgcggcagcgcgtcatgatcgcgatggcgatggcgctcgaaccgcaagtcatgatcatggatgagccgaccaccgcgctcgacgtggtcgtccagcgggagatcctccgggagatcacccggctgcgcgacgaactcggcttcgcggtcatcttcatcacccacgacctgccgctgctgctggagatcagcgaccggatcgcggtcatgcgcggcggcgagatcgtcgaactcggcgccgccgccgacctttacaccaccccgaagcacgaatacacccggcagctgctggcatcgttccccagcctcaccggcgaccgcggctccttcgtccgcggcgccatggacgaccggctgctcgcgctggacgcggtcgaagtggaggcgtcgtgaccaccctcgaagtcagcgggctgggcaaggactaccggctgcgggacggctggcggaccagcacgctgcgcgccgtcgacgacgtcagcctcaccctcggtcacgggaagaccatcgccctggtcgggcagagtggcagcggcaaatcgacggtcgccagactgctcctgcagctggaacggcccagccgcggcgagatccggctcgacggcgaaccggtcggacggcgcggggcgggactcgcggcataccgccggaaggtgcagatggtcttccaggacccgttcgcatcactcaacccgtaccacaccatcggccatcatctggcccggccggtgcggctccaccatcggcggatcaccgacaccgacgtacgggcgaaagtcctggaactgctggaacgagtgcggctgaccccggcggacaccgtggcccggcgacggccccacgaactctccggcgggcagcggcaacgggtggcgatcgcccgcgcgctggcacccaggcccggcatcctcgtcgccgacgaaccggtctccatgctggacgtctccatccggctgggcgtgctcaacctgctggccgccctgcagcgggaagaggatctcggggtcctgtacataacccacgacctggccaccgcgcgccacttcgccgacgagatcctggtcatgtaccagggcgcgatcgtggaacgcggcccggccgacgacgtcatcctgaacccgcggcacgaatacacgaaaatgctcgccgaggcggcgcccaacccggaacggcggatcggggaactccgcgggacagtgtgaagttcaccttttcgacccggaaggtgcgggtatgaagaggggatggatgtcatcggtgcgggattcggacgaaccggaacactgagcctcaaggtcgccctggaacggatcggcctggggccgtgcgcgcacatgctgccactgatcggggacgaggagcgctgccggctcttcacccgggcggcggccggcgagccgggcgcgctggatcgggccctggacggctaccgctcgacggtcgactggcccggcgtgtacttctggcgggaactcgtggaccggcacccgcgggccagggtggtgctgaccgtgcgggacccggacgactggtacgccagcgcggaacggaccatctgggccgcgtcccgacggccggcggcgcccgggctgacggcgatgcgggagatggtggacgcgaccaactgggtggggacgttcgacggacggttcggcgatcgggcgtacgccatcgaggtcttcaaccggcacaacgccgcggtgcgcgagacggtgcccgcggaacgacttctggaataccggatcggggacgggtgggagccgctctgcgccttcctcgggcggccggtgccggacgaggacttcccgcggctcaacgacaccgcggcgttccaggagcggctgagcggtctggggctctccgtcgatgccggtcgcacgcctacgggagcgacgaacggcaggtgaaaggtcggctcgtggagggccgtcccgttccggtggtttcgtcacaccgccgagataccctcgtgatcggtgcgtcgcgggacgtcgccgacacgaccgacgatcatgagggacatgcgatgagcgactggaacacccaagtcatcgaggagttccgggccaacgagggccgggtcggcgggccgttcgccggggcgccgatggtcctcatccaccacaccggtcggaagaccggccgcgagtccgtcaccccgctcatgtacctgccggacgacaccgaccgggacaccatctacatcttcgcctcgaaagccggcgcgcccgacaaccccgcctggtatcacaacctgaccagcgcgggcagcaccaccgtcgaggtcggcaccgagacgtatgcggtgaccgtcaaggaactgaccggcccggagcgggacgagcgctacgccgagcaggcgcgtcgttaccccggcttcgcggagtacgagcagaagaccgccggcatccgcaccatccccgtcctgcagctcacccgggccgcctccgcctgaccggcggcgagccgcccgagccgggcggccttcggctgacccgcggccggagccggtgatccgctcaaccgccggcggcgatccggggcccggccggcggcgtcgccctccggcgggtgatccgtggcatggcatgcggtgcggtgggtaatagcacggctgttcgacggaggaggatgacatggctgaccggaacaacgccgaaccgaacggcgacaaccgggtgaaggatcctgacgactggagcaccggtgacgagccggcgaccggggcgcaggagtcctacctgcacacgctcgcgaccgaggcgcacgaggacgtgccggacgggctgaccaaggcggaggcttcgcgccgcatcgacgatctccaggagaagaccggccgcggccgctgagcgccgggcggcctctggtccgccggagccgtcggctgtcggaccaccggccgccgaccggcccggggcggccggctcccgggtcgtcagcggcggtaccgacgtcggtcagtgacaggtgatcaccgggttgtcggtggtgagctcgccggccggattccgggtgtagagccagacgtgcaggtcgtaatggaccggcatgggcggagcgccgaccggcaccgggtggccgagcatcggtccgttgaaccggtggccgaacagggccggccggtcgccgtcggtacgcaggtcaccgtcggcgtccggtcggtaatactccaggccggccagatgcacccggccatggtcgccgcggacgtagagaagaatctccgggtgttccgggtcgatcctgggatcggcggccagggccgggttcgagtagtgcaggcccatgccggggacacaatcgtcggtcggcaggtagccggcccggaccgcctcccgcacgtcgcggaaacgacgggtggcggcgagcagcatcgaccgttccgccccggtcaatcgcagcccgtccggtcgcggatcagcgggcccggcgggcccggcgtgcgcggcgtgcgcggccgtcgagatgccagagtcggcggggtgcgctgccgtcggaacgccgggtccggcggcgtgcgcgggggtgggaaggttcgcggcgccggtgagtccgcaggccgccgtcgccgcggcggcgaggactattcggaacattctcatgtccgccagattgcggctccgcccacggcgatgtcccgcgtttccgctgatcaggcgcgaaggtgggactgcaggacgagggcggcggcgccggtggcggaggcggtggcggcggccagggagacggtgacggtgacgttgcggtgccaggtgcgggcgtcggcgggggccaggcggcgcatgatggccgggccgtagatggcggaggcggcggcgaaacccgggccggtgaggaccagcaggtcgatgtcgagaaggttcacgaccgtttcggcggcggcggcgacgtagcgggccgaggtctccaacagcgtgcggcagtgcggggcgccggcccgggcggcccgggcgatggcggcgaactcggtggccacgctgcggagcggctgggacaggtccaggccggcttcggcggcggcgacccgattgtcgcgggcggcgctgaccaccgtgcgggggccggccagaacctccaggcagccccggctgccacaccagcattccgggccgaagacgtccaggcataggtgaccgaattcgccggcgctggcgtgactgccgcgcatcgcccggccctcgacgacgatgccggcgccgatcccgccgcccatgtagagggcggcgaacgcctgctccgggccgacccgggcgacccagtactcgccgaccgcggcggcggtggcgtcgttctccaccaggaccggccagccggtggcggcggaaagccggctgcccagttcgtcgccgcccaggccgcgcagatggggcagcgggtcgtcggccgggccgccgctgtgcggccccggccagacgatgccgacgcccaggcaccgggccggatcgaccccggaaccggccagcagcgtgtcgatgtcggcggccagagtccgcagcagcagatccaccccgtccccgagccgatccccatcgccggaagccgtgacggaaccggtcgtggctggtccggccgtggcgggtccggaagtggtcgatccaggcgcggcggatccggacgcggtcgatccgggcgcggccgtcacgggttgatcggcggtgggcgcgggggcgggcccggcgctggtcccggtggtggatccggtgcgggtggcggacatggcggggagggccgggcgggccaggcgggagatgacacccccggtctgcccggtgaggacgtaggtggtggtgtcctcgtcgaggtggacgccgacggccaggcgggcggtcgggtccagctgcagcaacgtgcgcggtttgccgccggtcggcgtgcggccggtttcgacgaccagaccctcctcgaggagccgacggaccgtcatcgacaccgcggcctcggtcaggccggtgatcttggcgagctcgacgcggctgaggggctcgcaggcgcggatggcgtcgaggatgctctcccgggcgccggggcggcgaccacggccgggccggcctgccggcgcgggcgcgccgaccgcttctctcactcggtcaccctccccggggcggttgcggccgtgacgcgcacgagcacgacgcggtccggacagagcaccgggagccggagtccgacggtgccgagcgtgcggccgttcaggcgtaccccctggggcgtgcaccagggtaacgcagcaccccacgcgatggcgttgccgtcggcaacgtcacccgccggccggggccggacgtggtgcacccggtccggaccggtccgggcagcccggccgcgcccggcgggtacgaggcgctggtgcccgtcgcgatcaccgccgggctccggcagtcgaggaccaggctcatccgggcggcgctcaggtggctcaggtccgcgccgtcggcgactccccaccagcgttgacgggcttcgttcagtagcttaagaatatgagttgccgggtcgcggcggcacgacgacaggagtcaccccccagatgatcagaaccgacctgcactcgggctggaccgtgcgtgccgtgggcgggccggtgcccgcggagatcgccgccgggacggtgccggccacggtgcccggcacggtgcacaccgacctgctcgacgccgagctgatccccgatccgtacctcggggagaacgagtcgctgctggtctggttccaccgggcggcctggctctacgccaccaccctgcgggccgcgccggcggccccggacgagcgggtcgacctggtcttcgacggtctggacacggtcgccacgatcaccctgggcgacgccgagctgggccggaccgcgaacatgcaccgtggccaccggttcgacgtgcgggaccggctgcacggcgcgccgctgccgctgtcggtccggttcgactccgcgctggactatgccgagcggctgcagaaggtgatcggggaacgcccccggccctatccgcacccgttcaacgcggtccgcaagatggcctgctcgttcggctgggactgggggcccgacctgcagaccgccggtatctggaagccggtgcgcctggagcgctggcgggtggcacggctcgcctcggtgcgtccgctggccacggtggacgcggacggccgtaccggcaagtgccgcatctccatcgaggtggagcgatccgggctcgcggccgcgaccgcgctgaccgccgaggtcgcggtcgggtcgcagaccgtgccggtcacgctcccggcgacggccgacgcggtgacgaccgagatcaccgtgcccgacgcgccggtctggtggccggtcggctacggcgaccagccgctcgtcgacgtgcgcgtggtgctgcgcgacggcgacggcgacctcgacgtgttcgacacccgggtcggcttccggacggtgacgctggacgagacgccggacgcggtcggcaccccgttcacgctgatcgtcaacggacagccgatcttcgtgcgcggcctcaactggattcccgaggaccatctgctcacccggctgacccgggcacggtacgcggcggcgatcgagcgggccgtcgaggccaacgccaacctgctgcgcgtctggggcggcggcatctacgagagcgacgacttctacgccgagtgtgacgagcgcggcgtgctggtctggcaggacttcccgctggcctgcgcggcgtactcggaggaggagccgatccgctcggagatcctcgccgaggcccgggagaacgtcgcccggctcgccccgcacccgtcgctgatcctgtggaacggcggcaacgagaacatctgggggcaccaggactgggactggaaaccgcggctcaacgggcagacctggggcgccggatactactaccgggacttcccggcgctgctcgccgacctcgacccgagccgcccctaccaccccggcagcccgtccagcccgggccacgaccccgaaatcatccaccccaacgacgaccggcacggcacccgccacgagtgggaggcgtggaaccggcaggactacacccaccacgcgaacttcctgccccggttctgcgccgagttcggctggcaggcgccggccacctggtcgactttgcgcgagtcgttggctcccgaggacttcgatcaggagtcgccggcgttcctgctgcaccagaaggcggccggcggcaacgacaaactcgacaccgggttggcgcaccacatgcgggtgccggccgacttcgccgagtggcactgggccacccagctcaaccaggcccgggcgacggcgtacgcggtgcaccacctgcgcgggcacgcgccgcgcacgatgggcagcatcctgtggcagctcaacgactgctggccggtcacctcctgggcggtggtcgacggcgccggacggcgcaagccggcctggtacgcgctgcgccgcgcctacgccccgcggctgctcagcctccgcttcccgcccgggtcgccggacggcgcactggtcgcggtcaacgactcgccgacgccctggcggggcacggtgcgggtgcggcgggtctccttcaccggcgagccgctggccgaggggaccgtcgagctggacgtcgcgcctcgatccggatcggtcgtcccgctggacgccggactgaccacacccggcgacgtgacccgcgaggtgctggtcgcggacgccgacgggctgcgcgccacgcacctgttcgccgaggacttcgatctcgcgtacgacccgtcgcccctcaccgcggacatcacccccgccgagggcggatactgcatcaccgtgaccgcttcccgtttcgcccgcgacgtcgcgctgctcaccgacaagatcgaccccgcgtcgtccgtcgacgacctgctcgtggatctcctggccggcgagagccacaccttccacgtgcgcaccacctgggccgacccggcggcgttcggcgcgcccggggtgctcgtcgcggcgaacaccctcgccgccgcgaccgaggcctgagcgcggtggccggcgggctgatcgggctggtgctgaccggcagcgccgcgcaggtcggggtcgaaccgttcttcatggagctgatcgccggcatggaggaggcgctcgccccggccggcgccaccgtgctgctcctggtcgtccccgatcgggatgccgagctggccacctaccgccgctgggcgcaggaccacacggtggccgcggtggtcgtggtcaacctggtgcacgacgacgtgcgcccggaccgggtggccgcgctcggcctgcccgcggtgctggccggtcggcaccccggaccgtacgccaaagtggtcaccgacgacgctggggcgatgaccaccgcgatcgccgccctgaccgccctcggccaccgggtgatcggccgggtcagcggccctgccgacctggtgcacaccgcggaacgcaccgcggcgatccgggcggcggcggccgggcgcggcgtcaccgtgcggatcgccgagggcgactacaccgccgagggcggcgtacgggcgctgcggtccctgctcgcctcggccccgccgccgaccgcgatcgtcttcgacaacgatgtgatggcggtcgccgccgagcaggagctgctccgcaccggcacccgggtgccggcgcaggtcagcctgctggcctgcgacgactccccgctgtgtgagctcgcggtgccacccctgtcggcgttgagcaccgacgtgcacgagcacgggctgaccctggggcgggcggtgctcgacgtgctcgacgggggagcgggccgcacccacccgggcccggcggtcagcatccgccaccgggagagcaccggcccggctcccgccgctccgaaagtcagctggtgaagatgaagtacttccagggcccgttggtcgtggcgttggcccggtccccggagatgccggtcaggtaggccgccgacacccggtacttcaccccggtccggtgcgttccggtgagggtgtacgagtacttgccggccgagctgagccggtagttcccgctcttgaacgccacccaccggccgcccgagtactgctggagggtcagccgctcggtgcgtcccgggtacggcgtcatcgtcgtaccgaaaaccgggttcttgctcttgtgcacgtagtagtacgaccgcttgacggtgtagtggttggcgaccgtggtggcgacggcgaccgaggtgttcaccgccgaggtgaccgtccgggcggcgtatccggcgtcaccggcgaagaccacgctgaacgtggtgttgcgggtcagctggtagccgacgctcaggttgcccgcggcgtccaccacgcctttcttgagcagggtgcgcggccggtcggtgccgtacgggtcggcccagatctccacggtccggttctgggcggtggtgccgaggtgcgcggtcatcgtcacggtggcgccgtacgcgttgacgctcccgtcgcggttcagcgtgagctccggtgtggccggcgccggcgtcgccgtgggctggtcgatcacccacaggctctgcgcgccggtcggatcggtgctgatcgcgaagagccggccggcgccggcaccccacccgaggtcggtcacggtggccgtggccgggaagtcgaactcgcgggccgcggtcgtctcggcgtccgggtagagacgcacgtcgccggtgccggccgcgacccagccgtcggtggtcgccacgtcggcggcgccgtccaggccgatcgtgcgggccgagatgccggccaggtcgtcggcccaggtgtagaagacgccaccggcaccggccacgtagatcatcgtgccgtcgggggtgtacgccaacgtgttgtgcgcggcgagcacgccggtctcggcggtcaccggcgccgtcatgtcgccggcggtgtcgtagcggaacagggtcgtccgggtgcccgcgtaggtcagcgccaactgggtcgggtcggccgggttggcggcgatcagcggctgggacggcgatgccgaggtgtcgttgcccttgccgagcacgtaccgggtgaccgcgccggtggccgggtcgagcgaggcgaagtagttcttgtcgaaggtgaaccagggcgtgccgccggccagcgtgaggtggccgaggtcgaggaggtcgaccgggtagggcttggcgtcgccgagggtcgccgcgtcccaggagacgatctggtgggcgcccggcaggatcgcccagagccggcccgcgtcggccgtgagccgcaggtcgccggcgttcgccccgtccgggagggccacctgggccgcgaccgtgccgtcgtagccgaccgcgaggatgcggtgcgccacgtcgtcggcgatcagcagccgctggtgcaccgtgtcgaccaccatccggtcggcgtgatatccgtcgatcgcgtggcgctgctgcccggtcagtgtggtcggcccggtcccggccgacgccgacccggtcgcgaggttgacgaaggccgccgacccggccgccagcacgccggccgcgagcagtgtcctgatggtgcgcttgcgcatggtctctccccgggtacggacgaagcccgtagaccgtacccggtagatcagatattcgacgtgcgggccggatccagagtggcccagcgctcggcgagctggcggcggcggcaggcgaccaggtggccggccaggatcgccgggtggccgccgcggacgcacacgtcggcgccggcggtgaggatgccggcgaccagcgcggccggggcccactcgtcgatgaggacgacgatccggctggcgcggggcagggtgacccgggcctgccggacgtcctcgacccgggcgccgctgagcaggatgatctcgccggggcgggcgtcgtcgaggaccgtcagggcgcggaccgaccagccggagggcaggtgctgcggaagggcgccgacccggctccgctggccgaggaccgcgaccaccggatcggcggccggggccggggccggggtcacggtggtgggctgggccgcccgcgtgagctcttcgatcatggtggtcatcccctcggtgggtccctcgtgatgggttcacgattcgcccccagcctgaaggggccgtgtgccccgcctgtgcgttggttggcagccgcggggctcaggcggagtcgcggacgaccagctggatgaggtcgccggtgggcagtggcggggccgcccggccgccgaccgccgccaccaccgtggtggccaggtgcgccgccagcgtcagctggtcggtggtcaccgtggtcagcgggggcaccgcgaggcgggccgccgggatgtcgtcgacgccgatcaccgcgacgtcggtcggtgcggccagccccagccgccgcgccccggcgagcacggccagcgccacctcgtcgttgtacgcgcagatcgcggtgaccccgtcggcgcaccagcgggcgaccgccgcggacgcctgcgcggcgtcgagcgggacgacccgcacgaccgggtcgaccggtgccgcggcgcgcacgcccgcgaggcgggggtcggcgaagatctgcagacgcggatcgtccgggtaggcgtatccgagccgctgatgacccgtaccggcaaggtgctcggcctgtcgtcgtccgacgagttgttgcgggacctccagctcccgcccgtgccgcccgggccggccgagcagcgcgacgacgagggcgacgccggcggcccgcatcgcctcgcgttcgtcgtcggagaagtcggtgaacgacagcaccgccgccggggtgagcgccttccagatctcggcgatcggccggtcctcgcggctgccggggtgggcgacgaaggtgagtccctcccgggcgagcgcggtggacaggttgccgagcaggttgccgacctcgttgccgatcggccagtcggggagcaggcagaggaccacgtcggagcgtccggtgcggagggtgcgggcggcggcggacggggcatagccgaggccggcggcggcttgcaggacgcggtcgcgggtggccggggagatgctctggccgctggtgttgttgaggacgtagctgaccgtggcccgggagaccccggcccggcgggcgacgtcggcgctggtgatccggcggggctcgggcatggggtgactttactacttacacgtgtcagtatggatggatgactctcgacctcgccgccaaggtcgccctcctcaccggcgcgaccaccttcacgctcgccccggagccgcggatcggcctgcacgagatccggctctccgacgggccgaccggggtgcgtggcctcaagttcagcggcggccgggtggtcgccctcttcccgaacgcgacgctgctcgcctcggcctgggaccccgacgcggcgtacgaggtcggccggctcctggccgaggaggcgctggcccagcggatccacgtcgtcctgggccccaccatcaacctgcaccgcagcccgctcggcggccggctcttcgaggcgtactcggaggatccgctgctcaccggcagactcgccgcggcgtatgtgcgcggcatgcaggaccagggggtggccgcctgtctcaagcacctggtcgccaacgagtcggagaccgatcgcaccacggtggacagcgtcgtcgacgaggccaccctgcgcgaggtctacctgctgcccttcgagatagccgtcgaggaggccgacgcctggacgatgatggccgcctacaacgacgtcaacggcgccgcggcgaccgagcagcggcacgtcaacaacgagatcgtcaagggtgagtggggctaccgcgggctgatcatgtccgactggttcgccaccaggaccaccgcggcctcggcgaacggcgggctcgacctggtcatgcccggcccggccggcccgtggggcgacgcgctggtcgcggcggtccggcgcggcgaggtcgacgaggcggtgatcgacgaccacctgaaccggctgctgctgctcgccgagcgggtcggcgcgctcggcaccccgcgggggtacccggccggcctgccggcgccggcttccgccctccggcgggagcagctcacccgcctggccgcgagcggcatgacggtcctgcgcaacgagggcgccgtgctgcccctggcccgggacacgcggatcgcggtgatcggccggcacgcgctgcagaccatcgacatgggtggcggttcggcgcaggtcaacccgccctaccaggtcagcatcgcggaagcgctgcccggtgcggtgatcgccgacggggtcgaggtgcggacccgcccggtaccggcccgcggcggtttcctcaccgacccgcagaccggccggccgggcatccgggtccggatgttcgaggccgccgggaccgaactggagagccggttctgcgcccaggccaccaccatgatcggaatggacgacgacttcgacggcgtggtgcacaccgcggagctcaccggccggatcaccgggggcgggacggtcgagctcggcgcgctgggcgccggcacctggaccgtcaccgtcggcgagagccgcgtcgactaccacctggatctcaccgggaacggcttcggcgaggccgtcctcgctccgccgctgcgcgtcgatcgcttcgagaccaccgcgggcgacatcctgaccgcgcgggtccggctgctttccggcggttcgttcgcgaacaccggactgttcggtctcctcgcgcacaccgcgccccgcccggccgtcgacgtgctcgacgaggcggtccgggcagcggccggggcggaggtcgccgtggtcgtcgtcggcctgaccgaggagcaggagaccgagtccgtcgacaagaccaccctcgcgctgcccggcgcccaggacgcgctggtcgaggcggtcgccggggcggcccgccggaccgtcgtggtggtcaacgccgccaccccggtgttgatgccctggctgtcccgggtcgacgcggtgctctgggccgggctgcccggccaggagggcgggcacgcggtggccgcggcgctgttcggcgacatcgaaccggccgggcggctggtcaccaccttcccggccgccgacgggaaatccccggcctggtcggtgaccccggtggacgggaagctcgcgtacgacgaagggccgttcatcggataccgcggacatcacgcggggcgcgcgcccgaaccggccttctggttcgggcacggtctcggttacggcacctgggagtacgccgacgcccgccgcgtcgacggcgacccggccgccgtggccgtcacggtcaccaacaccggcagccgcaccagccgtgaggtcgtgcaggtctacctgcagccggacgacccggcgcagccggtgcggctggccggctggaccccggtcacggtcgcctccggcgagtcggcgcgggtcaccgtcacgcttgacagccggatgtggcgtgtgtggaataccacgtccggagtatgggagcgtgcttccggtggacaattgctgatcgctcgcggcttgggcgacatcagagccaccctgtgaccgggcggggccggcccgtcatcgcaaccgtcctgcgatgacgggccgcccgcccgatgaggcggaccgtcagcagggcgcgttccagctggccagcaccgggtcgacggcatgctcccaacccagcaccgacacggtcgcggtgtccagcttgagcagcccgccggcgccggccggcagcccgacccagcgcgccccggtcacccgcaggctgtgcccgtgcccgaccagcgcgacatcaccgtcgatcgcccgggcccgggccagcacccggtcgagccgctcgccgacctgctccggtgactccccgcccgggcagccgtgcacccagagtgaccagtccgggcggctctcccggatctgcctggtggtgatcccctcgtactccccgtaattccactcggccagatcctcggtcacctcggtgaccgtcagcccggccagctccgcggtccgcagcgcccgccgccgtggactggagatcaccgccgcgaaggtccgcccgccgagacgctcgccggcgcggcgcgcctgcgcttccccctcggccgtcaatgccagatcggtgtacgacgtgtgccgcccgttggcgctccactccgtctgcccgtgccggatcagcacgatctccgccatgtccccgccttccgttcgccgggcaccaccctgccacccggcggccgcgtcacccacccggcctgaccgggatcacctgcccggaccgcctcagtcgggcagtgcccccggcagcggcatcgggctgtggccctcctcgcgggcggcgatcccggacatcgcgtgccggtactgctccgcgctgagctcgccccgcatcagctgggcgatcaggatgccctcggtgctctccggcatcggcgggatcacggtggcgaccggcagcaggacggcggagagcgggcccggaccggtggccggccccggcccggcgaacaggccggacggtccgccgtgccgctgcggccagaaggtgaccgccagggcggcgatcgtgctgccgatcagcacggccagaaacatggcgatcatcccctcagcgctcatggcgggcgtcgtacccaccgcggcactgtgtctatacctcatcccggcaagagaaaacgacctccgccggactccgcccgcggtcggcgggcctcagggacggcagtcgggcggcaccgacatcgggtgccggcgctcgtcccgggcggcgatccgctccagggcccgaatgtactgctggctgtcgatctcgccggtcatcagctggacggtgagcacaccctccaggctgtccggaagccgcaatggcggcggcgcgacccggccccgggacacccgccgggcccgcgacgcgcgccgatcccgcttctcccggcgctcccgatcctcccgggtctcccgatcctcccggcgccccggttcggcccgagtctcccggcgctcgccggtcacccgccggcccgccggccacggccagaacaccagggcgagcgcggccaccaggccgagcatcgccaccagcacgacaatcatctgcggtacccccgtactcacgctccgcggacatcttcgccgacgctgtcacgcgcaccctccgccacctttccgacaccagagtgtgaccagcccatacgcacagtgccgcacaaagtcgctccacgcggatggcgccaatccggtcaaccagcccccgcccgcgcgctgtcaacccgccgatccggctcacccgagcggggggagtcgccggtccctcgtcgccggctggccaccgcttcggtcctcaccgggcccggcggtgccggccagcttcgctactcgtgacacggcccctggctcccgctcgcctctaccgtgccgcacgtccagggacggcgctctgacgatcggcggcacaacgacccgcccggccgacggcctccggtgtttccggcggcggtgagagtgccggcgtgcagagtgcctccgcgaaccgttccctggacgcgtcggtgccgccatctcgaaggcgagttcagcgggtggccagcaggtgggccatctcggtgcgggagcggacgcccaggcgggtgaagacgttgcgcaggtggtggtcgacggtgcgggggctgagatgcagctcctgggccacctcacggttggtggcgccggcggcgaccagggccgcgatccgttcctgctgggcggtcaggccgggggcggtgccggcgggccgggacggggtgccggccccggggcgttcgccggccgcccgcagctcgcggacgctctgcgccgcccacggttcggcgcccagcagccggaaggtctccgcggcccggcgcagatgttcgcctagctagctagcgaccccggcgccggagatcggagtggccgcgaccgaggcgccggagatcggaaagacggcggccgggggagcggagatcccggaggcggcggcctcggtggtgggggtggcggggccggtgggaatcacgacgccgctgggggtcgcgaggccgctgggggtggcgaggccgctgggggtcccgaggccggtggtggtcgcggcggcggcgcggtgcaggagggtgtcgaggcggcggccgcgcgcggccgagacttcggccagtgccaggtgcgcggcgcggcgcgcgatggcggacatctcgcggtacgtcgtggcccgcgcgagttccgacccgaaccgcaccgtggtgtcgtcgacggtgaccaggccggcgtgttcggcgggcagcaggtcggcgagcccggcgtcggcggcgtcgagcaggtcgggcaggggtgtgggcggcccggcggcggccagcagcagcagtcgccgggttggttcgggcagggcgtccagctcggtacgcagccgcaggcgctgcgggtggtccggtgccagggtggccggcagcggttcgtatccgcggcgctgcgccggggtgagcccggtggccaggtcggtgagtgccgccgggttgccgccggcgatcctgatcagcgcgatcgccacgtcgtcggcgaggtcgggggcgtgtgcgccgagcagggtgcggcattgctcgggggtgagcggcgggatgcggcgggtcggcaggtcgccggcggtgagcccgggcgggccggcggccaggatcacgaccggcagggtggtgaggcggtgcgcggcgtgcgcgatggcccgcagcgacggtgcgtcgagcaggtgggcgtcgtccagcagctgcaggagcgggcggtgggccgacgtcgtacgcagatggtggtgcagtgaccgtccggcggtgaggcggcggagggcggccccgggccgggcggtctcgctggcgtagccggcgagttcgtggaccgtccagccgccggcgagggcggcggcggtgcgcagcagggtggtgcggccggagccgggggcgccgcagagcaggagggcgccgccgtggccggcctcggcagcggtgagcagccgctgaacttcttgcactagcggtgcatgaaacatgtcgtgagtgttccccctcgcgcgtcgcatcgaaagaaggacatcgatgtcgtgcaaggggtgaaatttccgggatgttgcgccctgatgacacgaagccggtgatttcgccgatgcgcggctcgtccggcgctgcgcagactggcgctcgtcgatccgtttccccaggtgaaggagtgttcgacgtgcaccgatcttggaagcgactgctggcgacggccgccgccgccctgatgctctccgcaccactcggcgccaccgccgcgcacgcggccgacaacccgtaccagcgcggcccggccccgaccctggccgccctgcaggcggccagcggtccgtacgccgtctcccaggtgtccgtctcccggtcgagcgtgtccggcttcggcggcggcgtcatctactacccgaccagcacggccgacggcaccttcggcgggatcgcgatctcgcccggttacacggcgtactggtccagcatctcgtggctgggaccccgcctggcctcgcacggcttcgtggtgatcggcatcgagacgctgagtacgctcgaccagcccgactcccgcgggcggcagctactggccgctctcgactacctgaccaggagcagcacggtacgcaaccgggtggacgccagccggctcgccgtcgccgggcactcgatgggcggcggcggcagcctggaggcggccaacgaccggccgtcgttgcaggccgcggtgccgctggcgccatgggacctgaccaagtcgtggaccggcatcaaggttccgacgctgatcgtcggcggacagtcggacaccatcgcgccggtggcgagccactcgatcccgttctacaccaccatcccggcgtcgtccgagaaggcgtacctggagctggccgggcagagccacttcttcccgcagacggtgaacaccacgaccgcggtggaggcggtggcctggctcaagcggttcgtcgacaacgacacccgctacgaccagttcatctgcccggggccgagcagcgtgctggtctcggcgtaccgcagcacctgcccgctgtccgccggctgatccggacaggaccgtgccggcgtcgtcagacggggggcaaccgacgccggcacggggatcagggtgcggtcaggagctcggcgccgccgacggccgcagcaccttgcaggtctcgatcgccttctcggtggtggcatccgacgggttcggatcggccacgtcggtgacgccgttcttcttcaggcagtcccggtacgcggcgttcgccccgccgcccccgccgttgccgcgcccgccgaagctgggccgcaccgacgcgcacgcctcctgtgccctggtccaggtcgcctcgtccacgtccgccggtttctggaagaagccgccgccacccgggaagccgccccggccgccggcgccgaaactgcccgaggggcgcggcatgccggacgggcgcgcgccaccggaagggcgcgggccgttgcccggcccgaacgacggcagggtgatcgtgacgccgttcttcgccagacatgcggcgtacgccgtgaacgccgcgttgttgccgccgccgttctgtccggtcgcgccggtcgacgtgccggtgccgccgtccttgccgccgcacgccgcggtgaaggccaccgagacgaacgccaccgccgcgcacgccgcgatccggcgggccgccttcgacttgactaccggcatcatcgtctcctcatcgacacgggcccgcccggggaagaacgcggcgggacacgacggcacagcgaaccccggcttcctatgcggaaggtcggacgagcctgggaatctcctttgagccggcatcgcggctcccagggaactccgaggcgggaccgaggccgccgcgaggaccggtggccagactcctcgaccatgggtgttgcactggccggtcgccggcgtgggatctggctcggcgtgaccgtcgtcgtgctcgcggtgctcggctacgcggtggtgcgggcgatgacggcgggtggcggggcgaagacgaaggcggccgagaccgtcgcggtggaccggggcgcggtcagcaccgaggtggccaccaccgggacgctggccgcggcgcagacgcgcagcctgtcgttcgcggtggccggcaccgtggagacggtcaaggtgcgggccggcacgacggtcaccgcgggccaggtgctcgccacggtggacgacgacgacgcgcggcaggcggtcgacgacgcgcagtccgcgctggatgacgccgaggacgcgctgaccgcggcgaagaagagcgccggcgcgacctcctcgacgacgacgtcatgtgtcgcggccgcggcgtaccgggtgagcccctcgccctcgccgtcgtcctcgcccagcccgtcggcgtccgcgcggccgtcgaggaccgcgaccgtgacaccgacgaaggcgccggcccagggcggcaccggcaccgggacgaactgttccgcgaacggcggcggcaccacccgacagggcgggcagaacggcggcggggaccagatcctcagcgcccagcagcgggtcaacgcggccgaggtcaccctgcaggagagggaggatgccctggccggcgccaccatcaccgcgccgatcccggggcggatcctgagcgtcggcggcaaggtcggcagccgggtcagctccgggtcgacgttcatcagcctggccgacatctacgacatgcagatcaccgcgtcgttcccggaggccgacgccgaccatctggcggttcagcagaaggcggtgatcaccctggccgacaagccgggcgagacgttcgccgccaccctggtggtggtcgacccggtcggcaccagcgacggcacgctgacgacgttcggcgtggtgctcgccttcgccgacgcgccgaaggacctgctggtcgggcagagcgcccaggtgagggtgaccaccggcagccgggccgccgtgctgcgggtgcccagcacggcggtgcacgacgtggccggcacgtccggcacggtccagaagaacggcgccgaggtgagcgtgcggatcggcctgcggggcgaccggtacaccgagatcacctccggactggtggagggggatccggtgtcgcgatcctggtgatcggtgaggcgggccggacagccgcctcatagccgattcaaagaaaacattggtacttctgtgcggtgctatccgaaacccgttaccccatgaccgtcggcgacgcgtcggcgcgggccacccgcgtcctcgtcgtggacgacgagccgaacatctccgcgctgctcagcgccactctgcggcttgtcgccttcgacgtgcgggtcgccgagaccgggcacgccgccctggtcgcggtgagcgaattcgagcccgacctgatcgtgctcgacgtgatgctgccggatgtggacgggttcgaggtggcccggcggttgcgtgccgccggctcccggaccccggtgctgttcctcaccgcgcgcgacgcggtcgaggaccggatcgtcgggctctcggccggtgccgacgactacgtgaccaagccgttcagcctggaggaggtcgtcctacggatccgcgccatcctgcggcgcagccggccggaggaaccgaaaccggacaccggggtgctccggtacgccgacctggagttggccgaggacgcccacgaggtgcgccgggcgggccgtctgatcgagctgtccccgaccgagttcaacctgctgcgatatctgatgatcaacgcgggccgggtggtcagcaaggcacagatcctggatcgggtgtggaagtacgacttcggcggggacggccggatcgtcgagtcctacgtctactatctgcgtcgcaagatcgaccggaccgagccggcgttgatccacaccgtgcggggcgtcggctacgccttgcggttgccgcgcgagggggaataggtgtcattccgctcgggggcggtgggcggggcggtcggatgggagtgacgctgcgctggcggcactggacgctgcagtcccgcctcgctctggtggtcggcgtgctcgccgcgatcgcgctgctcgccgcgaacgtcgccggcgtcgtgctgatccgcggctacctgctggaccggatcgacagacagctcaccggcatggcccggccgatggagttcgcgaccccgccgtccggcggcttcgtcgcccgccgtggcttccggatcggccccgagcaggtgtcctacctgttcgccgccgacggcacgctcgacaccgagaacagcagcacggccgaccccggcaagcccgcggtgcccaccttcgagcaggtcaggacgcgcgccgccacccggctgccctacacggtgaccagcgccgacggcaccgactggcggctgttcgcgctcccggtcggcaccagcggcaggtatgtgctgttcggctcctcactggacgaggtgcggcagaccaccggcaagctgatcaccatcgacgccggggtgctgctgctcatcctgggcctgctcgggctcggcgccgcgttcgtggtccgggtcggtctgcgcccgctcaccgagatggagcacgccgccgcggacatctccggcggtgacctgtcgctgcgggtgccgggcgcggacccgcacaccgagccgggccggctgggtctggcgctcaactcgatgctcacccggatcgagaccgaggtgaccgcccggaccgcgtccgagcagcggttgcggcagttcgtcgcggacgcctcgcacgagctgcgcaccccgctcacctcgatccgcggcttcgccgagctgtaccggcgcggcggcgccccgcccggcccgcggctggacgagacgatgagccggatcgaggccgaggccggccggatgggtgtgctggtcgaggacctgctgatgctggcccggatggaccggcagcgcaccctcgacctgcgcccggtcgacctgctggagatcgccgcggacaccatccgggatgcgcgcgcccgggtgcccgagcgtccggtgctgctctccgggctcagcgacgacgcggacaccttcgagccggccaccgtgctcggcgacgaccacgggctgcggcaggtggccaccaacctggtcgccaacgcgctgaaccacaccccggccggaacccgggtcaccgtccgggtcgggcacaccgtcgccggacccgccgacgaggctgcggcctgctccggctcgatcactttccgtgatggattgccgctggcggtgctggaggtggaggacgacggccccggcgtgccggacgagcacgcggcacggatcttcgagcgcctctaccgcgcggacgccagccggaaccgcggcaagggcggtggttccgggctcggcctggccatcgtggcggcgatcgtgcacggccacggcggctgggtggagctgcaccacacgcccggcggcggcgccaccttccgggtactgctcccgtcgatcggtgacgcgccgtgagattctgagctggctccgaggttgcgccgaatctcctcccaggccgcgccaccagagtgacggccatgaaggtacgcctgagccgccacccgtccctggtggtcaacgccgtgatcggcgtcgtgctcgtcgccggtgccatcacggtgtacgagacattctcctcctccgacgccggcgcgacggccgccgcggcctccgaccggacggtgtcggtccagcagggcacggtcaccaggacggtgaccgcggacggcaccgtggagagtgccagcaccgcgagcgccagcttcgagaccagcggaacggtcaccgagatcgacgtcaaggtgggtgaccgggtcaggaagggccaggtgctggcgaaggtcgacccggccgcggcgaagcgggcgctggccgaggcgcaggcgaacctggatgccgcgaacgacgcgtgggaccgcgcccagaccgccggctccgacaccaccgacgcggagaactcggtcaccacggccaagctcgcggtcaccgacgcggccgccggggtcgccgggaccacgctgaaggcgccgatggcggggacggtcacctcggtggccggcaccgtcggcagttccgccgccggcaccggctcgtcgtcgtcctcgtcgtcgcaaggcggtggcggttcacccggcggcgggggcaccacctcgtcctcgtcgtcctcgtccgccggcttcgtcgagatcgccgacctgagcaggatgcaggtcagcgcgagcttcgccgaggcggacgcgaccaggctgaaggagaagcaggccggcacggtcacctggaacgcgctcagcggcaccagcgagaccgccgaagtgaccgcgatcgacccggccggcaccacctcgaacagcgtcgtcacctacggcgtgacgctgaccctggacagggtgccggccggcgcgaaggtcggccagaccgtctcggtggtggtcaccaccggctccagggcgaacgtcctcatggtcaactcggcggcgatcaccacggtcggcaaccggcacacggtcaccgtggtcgcgaacggcgtcacggagacccgcccggtggagatcgggctggagggcgactcggccaccgagatcacctccgggctcgccgcgggcgagcaggtcaccgtaaagatcacctcgaccagcgccggttccggcaaccaggggggctttccgggcggcggcgccggtttccccggcggcggcggcaacttcggcggcggcggcaacttcggcggcggcatcggggcccgcgccggcggcggggccggccgatgagccgtccggtcctcgaggtgcagaacctcaagaagatctacggtacgggcgaggccaccgtgcacgcgctgcgcggggtgtcgatgaccgtgcaccgcggcgactacgtggcgatcatggggtcgtccggctccggcaagtcgaccctgatgaacatcctgggcgcgctggacatccccaccgtcggatcgtacaaactggacggcgtcgaggtgggcacgctctccgacgcgcagctggcgctggcccgcaaccggctcatcgggttcatcttccaggcgttcaacctcattccccgagcgacggcggtggccaacgtcgagcttcccctcgcgtacgccggggtgaaatccggagagcggcgccgccgcgcgatggccgccctggacatcgtcggtctcgcggaccgcgccgaccacgagcccaaccagctctccggtggccagcagcagcgcgtcgcggtggcccgggcgttggtcaccgagccggccctgctgctcgccgacgagcccaccggcaacctggacagcaggtccaccgacgacgtgctgcaggtcttcgacgacctgagcgcggccggccggaccatcgtgatcatcacgcacgaggacgaggtcggcgcccgtgccaaacgcctcgtccggctggtcgacggggcgatcgtgaccgacgtccggcagtccccgatcgacctgccgccggtcggcgcggtggccgcgcacgccggggtacggggggtggccgccggtcacccgccggccgggcaggccgtcgcggcgcgcgcgaacggcaccgcgaccacctatggccggccggccgcggaccggagcggggggcggcacaccgcatgaacttcttcgaggtggtccggttctcgctgcgcgggttgtcggcgaacaagttgcggtcctcgctcaccatgctcggcatcctgatcggtgtggccgcggtgatcctgctggtcgcggtcggcaacggctcggccaaggcgatcagcgaccggatcgaggcgctgggcaccgacacgattaccgtgatgagcaccggccggggcgggtcgagcagcaccgcgctcaccaggccgatggccgacgccctggtcaactcggagctggccccggacatcaagtcggtgtcaccggtggtcagcgcctcctcggcgaccatgacctacgagggcaccgaccactcggtgagcaccttcgtcggcaccgtgccgacctggttcggcgcctccagcaccccggtggagaagggcgcggcgttcaccgccgacgacgtcgcccaggggcgccgggtcgtggtgatcggacagaccgtggccgaggaactgtttcccggcgtcgatccgatcgacaggcaggtcaccgtgagcggcgcgctgttcaccgtgatcggggtgctcaaggagaagagctcgaccggtttccaggacgccaacgacaccgcggtcgccccgctcaccgcggtgcagcaggtgctctccggctacggcgcgctcacctcgatcatcgtcgaggccaacgaccccggcagggtgaacctggtgcagagcgaggtcgccacgatcctcgaccagaagctcggcgtgaagtcgtcgaccaccgcacggacgtccggcggtagaaccaacggcacgggcagcggtacgccgtaccggatccagaacgcctcgtcgctgctggagacccagaccgcgaccgccgacacgttcaccaccctgctgggcgcggtggccgcgatcagtctgctggtcggcggcatcggcatcaccaacatcatgctggtcacggtgaccgagcggacccgggagatcggcatccgcaaggcgctcggcgcccctcgccgggtgatcctgacccagttcctgatcgaggccaccctgctgagcgtgctcggcggcgccctcggcgtggcggccgcgctgatcggcagccacttcacgatcgtcggcgtgaaaccggtgatcgtgcccagttcgatcgggctcgccgtcggggtgtccatcgcgatcgggctgttcttcggcggcctgcccgccgcccgcgccgcccgcctgcgtcccatcgacgcgctgcgctacgagtgaggactcaccagtgaaccggatgaacgacgagaccgccgtgctgccgaccatcccggcgccggacgccgacccggccgggcccggcgacgacgacaacgagggcctggccgaggaactcgccgcggccgccccccggcagtggtggaaccgggggacgatcgggctgggggcggccgtgctgctgatgggcggcttcctcggcggcgtctacgcgcagcgggagtggggcccgaagacgaacgcgacctcgggcttcccgggccccggcggccgctttccgggcgggctgagtgccagcggcttccccggcggcggcttcggccagggcggcaccggccggggcgggacggggaccggtggcaccggcaccgcggcggccgcggccgacacgaccggcacggtgaagctggtcagcggcaccacgatctacgtgcagaccgcggacggcacggtggtcacggtcaacaccgacgggaagaccaccgtgtccgcggcgaagaaggcaaagctggccgacgtcaaggccggcgacgcgatcaccgtccggggcgaggccggtaccgacggcgcggtcgccgccacatccgtcatcacgcagcacaagtgacgaaccacccattgaagatcgcggctctctctccctaggctgagcccagctcagacctagtgcgtacccggaacccggccgagtgcgaggcgaggtcaggagtgtggccggcagcgggcgcgaaacgctcgcacaccggtgttgatgggggcgttccgcggacgctgccaggcgcgctcctggccacgccgcagccccggtcggcttccgggcacggactagggggtggcgcgttggggcgcgactcgccgattctgttcggccgggcgggactgctcgcggagatcgacgtgcggctcgccgtgggcggcggagtggcgctctgcggtccgcccggcatcgggcgcacggcgctgctcgacgcggtcgccgagcaggcggtggcccgcggtgagctgctgttgcggctgcggccggcccggggcgagcggaccctggcgtacgccggggtcgccgacctcgtccggcaggtcccgccggacctagctagctagtggccgccgaacgcctggactggctggtcaccgcggcccgcaccgcgctcaccggtggcgcaccggcgctggccggccgggccgccgaggcggtgatcgccgccgacgccccggccgggcaccgggtccgggcccgggtcgtgctgatcgatctggccggccaggcgctcggcgagatgggcgagatgttcgccgcggccctggccgaggccggcgacgatccggccctgctcgccccggtccggctgcggctcacctggcaggcgatgatcaccggcgagcccgaccgggcggccgccgaggcggtcgccaccgccgagatcgcgcaccgggccggcgacgccaccagcgaggcgatggcgctcagcggcctggcccagatccagcggatgcgcggcgaaccgcggtggcgggagtcgctggcccgcgccctggccctgccggcctttccggcgccggactggctgcactacggcccgcactacatggccgcccggttcgcgctgatcgacgaccggctcgacgaggcgcgcgccgagctgctgcgcctgctcgcggtcgccgaacacgaccggatcggcgaggcccgggtcgaggtgctgcgcagcctctccgaggtggcgacccgggcgggccgctgccgggaggcgctgcgctacgcccaccgggccgtccaggcggcgcaggaggccggcctgagtcccggtcccacctggtacaccgcggccgtggcggagctggccggcggcagtctcccggccgccgccgggttcgcccagcgtggcatccgcgcctccgaacaggagggggacaacctctacctgcgccgcaacctgcacgcgctgggccaggccgggctgcggtccggggacacccgggccggggtggccgccctgcgccggctgcgcgacctggaggccgaggccggcaactcggatccgatgatcgtccgctggcacgccgacctggcggccgggctggccgcgctcggcgagcacgtcgaggcggccgagaccctggcccgcgcccgcaaagccgccgaacagctgggcagcaccccggcgctggccggctacctggaccgggcgaccgcgatcgtgcagtcggagagcggccaggcggagtccgcggtcgagttgtcgaccgccgccgcccagctgttcgagcagctgcgccagccggtcgagcaggggcacgccctgctggtcgccggcggggccgaacgccgtcgccgccggtacgccgcggcccgcctgctgatcggcgcggcgctggccatcttcatgaacgcggacgcccggccgtgggccgaggagaccgagcgggcattggcccgcaccgagggcagcctggcgcccgagcagggactcacgtcgaccgagctgcggatcgcggtgatggtgcgggacggggccagcaaccgggagatcgcgtcccggctgtatctgagcgtgaagaccgtggaggccaccctgacccgggtgtaccgcaagctcggggtgcgctcccggacgcaactctcgtcacgtcttcaggtgctcgaaggcgacccgacgtaacaggtgccgtgggtcactgagggtgacgcgggatactttcgactttgcgcttttacctgccggattcccggatgaagcagaggtcgggcagggttgtgggagcaggctttctccgtcactgtccgttaaggagtgcccgatgcctacccttcgtcagatccgtgtcgccctcgcccaccgtctcgccgagcgccgtgcccaccgccggttgagcgaggagctcgcggcgttccgcaccgccgccgaacggaccgaactcgatctcgtgctggggcggcacaccgctgaggagacccgcgcgatcgaggccatcctcagccggcaggacgccgaacggcgctctctcggcggcagccccgcgacgggcgtcgtccggtagccgcggaccttccggtcggccggcaaccacggcggcgctcgtcggtacacactggaccgtgggtcatcatgcccgctcgggaccgtccccggagcgtgccggcccccgacgatcgccccgggcgcccccacggcgccgggggcgatcccgtcgtcgggtccggcccgggccttttccctcccggggcggcgccgttaccgtcggggctcctgctcggggtgtgccttcaggctgccggcgtgtgctttcagtgccggatcgcggcgggacctggccaggctcgccaccgtcgtgatgaccaggatgccgatgatcaccgcgagcgacaccggcgtgccgacctcggggactgcgtggctgatcgccttgtgcgcccagtgcagcacgagtttcaccccgatgaaggccagaatgaccgcgagcccggtggacaggtagaccagacggtcgagcagccctttcaccaggaagaacagcgcgcgcaggccgagcagggcgaacgcgttggcgacgaagacgatgtaggcctgctcggtcaccccgaagaccgccgggatcgagtcgagggcgaacaggatgtcggtgctgccgatcgccagcaggaccagcagcagcggcgtcaccatccgcttcccgccgacccgggtgatcatcttgccctcgacgtagtcgtcggtcaccggcagcagccggcggccggcccggaccagcgcgttgtcctcgatgctgggatcctggtcgcggtgccggtaaagctggacggcggtgtagatcaggatcaacccgaagatcaggaacatgaacgagaacaggttgagcagggtggcgccgagcgcgatgaaagcgacccgcaggaccagcgcgatgatgatcccgaaggtgagcacctcctgctgataccgctcggggacggcgaaggtgctcatgatgatcacgaagacgaagagattgtcgaccgacaggctcttctcgacgatgtagccggcgaaatactcggtgccgtagccccagccggcgacgctcgcgaagacgaggccgaaggcgaccgccacgccgatgtagaagatcgaccagccggccgcctcgcggaagccgacgacgtgcggacgcaccacccccagagtcaggtcgagggcgagcagggcgacgatgacgccaatggtcagggtccagccgagcgcggtgacctctagcatgcttcaaggatcctcgacgttgctgtaaagaacgccccgaaccggctggatgatccctgtaaacccgccctttccgccgctcggcgcgggtgaagcgcgctccggtcagctgcccgggtactctgatcggcgccggcgtgttccggtcagctgcccgggtactccgctcggcgccggcgtgttccggtcaggcgctgacgaaggaacgcttggccaggcccatccagaaaccgtcgatcggctgctcgggcgcctgctccggcgcgccggacgcgcccagggtgaggaacatcggcgcgaagtgctcgatggtcggatgtgcgtagggcatgccgggcgccgccgaccggaagtcggccagctcgtccaccgcgccgcgggccagggtctcggccgcccacgcgtcgaactcgcgggaccatccgggggccgccgcgtcgggccgccagtcgcgcaggaacggcaggccgtgcgtggtgaagccggacccgacgatcagcaccccctcgtcgcgcagcggggcgagccgggcgccgagctccagcagccggtcgggctccagggtgggcagcgacatctgcagcaccgggatgtcggcctccggatacatcacggtgagcggcacgtaggcgccgtggtccaggccgcggcgggtgcgggcgaccgtctcgccgtccggcatcagcgcggcgacccggtcggcgaggacgggggcgcccggagcgcggtattgcacctcgtagtagcgctgggcgaacccgtcgaagtcgtagaccagcgggacggtctcggtggcggacagcatcagcggggccgactcccagtgcgcggaggccatcaggacggccttcggccgggggagggcggccgccaggtcacgcagctgcgcgacccaggtggggtcgtccaccaggggcggcgcgccgtggctgaggaacagggccggcatgcgcacgatgacctccgttgaaacttcaactatctgcaccgaacggtacttgatgcgtcaactatccgcaaggaaaatgacgtaccgtaataatttgatctcgatggtctagggtttgatcgagccgtgccactctctgcgggtgcggcccggcgtcgagaggagaccggccgtggcgccgccgcagctaccgcccgcggatgatctctacctgaccgcgcacgacgcgagcagtggccggccgctgctcggatcggccgccctcggtctcggcctgggcgccgcgctgctcggcgagctgatcctgtggcgccgcatcgacctgatcagcgccggcctggtggtcaccgacaagcgtccgaccggcgacaccgccaccaccgcgctgctggagcggatcctgcgtgaggccgatcggcgcggcctgcgcgactggctcgcccggctcgccaccggcagtgccaccgacctggtcggacgtcggctcgcccgcggtggcctgatccggcgggtggagagacgcggactgctcggcaccaggagctcgttcgtgccggccgacgcgatgaccgcggcctggccggccacccggattcgcaccaaggtcgccggcagcgagccgctcaacgtgcccgacctgctggtttccggcctgatccgggccaccggcctggaccggcaggtgctggccgccctcaccgcgcgtgaccgggaccggctgtccgagcagtcccggcgggatcttccggccgagctgcagcagctcgtggcgcaggtcgaggcggccgtcgtggtcgccccttttcgtccgatgtggcgtccaggctcttgacgcggacgcggtcgcgtaattacatcgagaccaggtccactcagcgttgctggacggttaccccgcgctgacggcttggttcatcgcgttgcgtccgtgaccgcacgggacctgaccctcccgggtggctaggccggagggggcgggcatgtccgcacacgaggtcctgaccatgggacggatcggcgtcgatctctacccggagcagctcgggacaccgctcgctcaggtacggaccttcgccaaatccctcggcggcagccccaccaacgtggccgtcgccgcggcccggctcggccggcgcgccgcggtgatcacccgggtgggcgccgacccgttcggctcctacctgcgggatgcgctccgccgtttcggcgtcgacgatcggttcgtcggcgtcgtcgagcacctgccgacccccgtgacattctgtgagatctttccgccggatcggttcccgctctacttctatcgctaccccagagcccccgatctggagatttccccgtacgacgtggacctggccgccgtgcgcgccgccaccatcttctgggtcaccgggaccgggctgagcgccgctccgtcccgggaggcgacactggccgccctgcgggcccgaggccgcaccggcgtgaccgtcttcgatctcgactggcgaccgatgctctgggcgtcgccggaggaggcccggccctggtatctcgaagccctgcgatacgccaccgtcgcgatcggcaatgtggacgaggtggcgatcgcggtcggcggcatcggcggggtggttgccgcgtctgatggcgtcggcggggcggcaaccgcggggggtgacgacgacctgctcggccggttgctcgccaccggggtcgagctggcggtgctcaagcaggggccggcgggggtgcgggccgccacgcggacggaaacgacgtacgcccccgccatcgaggtcgacgtggtgaacggcctgggcgccggcgacgccttcggcggggccctgtgccacgggctgctcgccggctggccgctggccgagacgatccgtttcgcgaacgccgccggtgcgctcgtcgcctcccgactggcctgcgccgacgccatgccgaccgccgccgaggtgcacgaactgctggccgccggtcgcgctcccgcgcgcctctcggagagccccgacctgccggatgtcgatcatggctgaggcccgggccaatccggtcgtgccgcgcggttccaccgccgaccggccgtacgacgtggtggtcagcccggagaacgcgggctgggcgcacagcggtctgcgcgtggtgcagctgccggtcggcggacgcgtcaccttcgtcaccggcagcgacgagatgctggtgctgccgctgtccggcggttgcgacgtggcctgcgacgacgaacgcctgacgcttaccggccgccggtccgtcttctcccgggtgaccgatttcgcctacctgccgcgggatgccgcggtcaccctgcgggcgccgaacggcggccggttcgcgctgcccgccgcccgcgcccgccggcaactcccgttccgttacggagcggccgaggacgtgccggtcgaactgcgcggtgccgggtcggcgagccgtcaggtgaacaacttctgcacccccgaatcgttcgaagccgacgcgctgatcgcggtggaggtgctcacgcccggcggcaactggtcgtcgtatccgccgcaccgccacgacacgctcgaagagatctactactacgaggtggcgacgtcgccgtccgggcggcccggctgcggctatcagcgcgtctacggtgatcaggatcggccgatcgacgtgtgcgcggaggtgcgcaccggggacgtggtgctgattccgtacgggtggcacgggccgtcgatggccgcccccggctacgacctgtactacctcaacgtgatggccgggccgggggagcggcggtggctgatcaccgacgatccggcgcacgggtgggtgcgcgaggcctgggcggtgcaggctgtcgatccgcggctgccgctgaccacagaccgcgaactgctgacccggaggcggacgtgagacggcatcttttacgggtggtccggtgaggcgccggcgcaccgtcgcgagggcggacgtcaagcggcatcctctgcgggggtcgaggtgaagcaccggctcaccgtcgcgcaggcggccgtccgattcctggccaatcagttcaccgaacgtgacgggatccgcgagcgggcggtggccggctttctcggcatcttcgggcacggcaatgtggccggaatcggtcaggcactggtgcaggcgcaccgcaccgggtcgccgtcgatgccgtaccgtttggcccgcaacgagcaggcgatggtgcacaccgcggtcggctatgcccggatgcgcaaccgtctgtcgacgatggcctgcaccgcgtcgatcggtcccggttcgaccaacatgctgaccggcgcggcactcgccacgatcagccggattccggtgctgctgctgccgtccgacgtgttcgcgacccgggtcgccaccccggtgctgcaggaactggaggatccgcgcgccggcgacgtgtcggtcaacgatgcgttccggccgctgtcgaagttcttcgaccgggtctggcggcccgagcagctgcctgcggcgctgctcggcgcgatgcgggtcctgacggacccggcggagaccggtgcggtcaccgtctgccttccccaggacgtgcaaattgaggcgtacgaatggccggacgacctgttcgccgaacgcgtctggcacatcacccggcctgttcccgacccgttgtccgtggagcgggcggccgccgtgatcaggggcgcgcgccggccgctgatcgtggccggtggcggggtgatctactcggaggcgtcggcgcagctcgaccggttcgcccgggaaaccggcatcccggtcgccgacacccaggccggcaagggcgcgttgagctgggatcatccgaacgaggtcggcgggatcggggcgaccggcagcccggtcgcgaaccggctcgccgggcacgccgacgtggtgatcggcatcggcacccggtattcggatttcaccaccgcgtcccggaccgccttccggcatccgcacgtccggttcgtgaacctcaacgtgacctcgttcgacgcgggcaaactcgccgcgctgccgctggtcgcggacgcccgggccgggttgcaggcgttgcgtccggcgctgcacggcaggcggttcaccgatgagttccaggaggacgtggccgggtggaacgcggtcgtcgccgcgcatctccgaccgggcggcggcttgccgacgcaggcgcaggtgatcggcgtggtcaacgacgcgtgcggggcgcgcgacgtggtggtgcaggcggccggcagccttcccggcgacctgcagcggctgtggcggtcccgggatccgaagcagtaccaggtcgagtacggctactcctgcatgggcttcgagatcgccggcgccctcggcatcaagctggccgacccgtcccgcgaagtgttcgcactggtcggcgacgggtcgtacctgatgatggcgcaggagatcgtcaccgcgatcgccgaaggcgtgaaactgatcgtcatcctcgtgcagaaccacggtttcgcctcgatcggcgccctctccgaacaggtcggctcgcagcggttcggcaccagctaccgctatcgcagcccgcagaccggcgactacgacggcgcgctccttcccgtcgacctggcactgaacgcggaaagcctgggcgccgcggtgatccgctgccgcaccacagccgacctggccgagggcctgaagagagcccgcgaacacgaccatctcaccctcctccacatcgagaccgacccactcgccgccgccccgtcctcggaggcgtggtgggacgtcccggtcgccgaagtcgccaccctgcacagcacccgccacgcccgcgccgcctacctcgaagccaaacgcgaccaacgcccccacctacgccccggtgactgacctccccgaccacctacccgcactcggaggctgacttccccgaccacctacccgcagccggaggctgaccaccccaccgcccaaccgcacccggaggccacccgatgtgcccgagccacccccgtcccgccggccactccaccgctggcgccgtatccgcccccaccccgctgccggcatccgcttgctgccgacccctcgtcagacgatcacttccttccgccgtccctgaccaggtcgctgccaaaccccggccttccgtcgcggcgcccttgtcgagggcgtggtgagccccgtgcgccggctgcgactcggcagctgccccgattcctggggtgtctggtacgccgcggatccccggcagatcccctggtcccggttcctcgacgagctgaccgaggccggttaccgctggctggagctcggcccacacggctacctgcccaccgaccccgctcaactcgccgacgagttggcggcccgcggcctgtcctgcgccgcgggcaccgtcggcggcgtcggcggcccgcacagggactttccggccgtggtcgccgggacccgccgcgtcgccgccctgacccgcgcggtcggcggccgcgacgtcgtcttcgtccctgttcccggttaccgcgacgacgccaccggcggatacctggaacccgccacgctcggtgccggccagtggcgcgccctgctggacaacacgaacaccctcggccggatagtcaccgaggagtacggcctcaacctccgtttccacccgcacgccgactaccaggtggagaaccagtctcagatcgaacgcttcctggacggcaccgacccccgcttcgtgtcgctgtgcctggacaccggccacctcgcctaccgccgcgccgacatcctgtcactgatcgccgcctatccctcccgcatcggatacgtccacctgaagcagatggacccggacatcgccctccgcgcggaagccgaagatctcgctttcgcgcaggccgtggctctcggcgtcagtgtcgccccaccacgtggcacgcctgacgtgccgaccgtgctctccgcgctcgccgccctggacgcggatctgttcgtcgtggtcgagcaggacatgtatccggtcgacttcgacgttcccctgccgattgccacccgcacccgccggtatctggaagagacaggagacttcgcatgaggaaacgcctgcttgccgccgggacggccaccgtgctcgcgctggcggcgtgcagcggtggcggccgggacaagtccgccgcggacacttcgggcgcgggcggcaacgcgcccggcagttccggttacacgatcgcgttcgtcactcatgagacccccggagacacgttctgggacaaggttcgggcgggtgcggtgcaggccgccaaggacgagggcgtcacgctgaagtactccaacgacccggacgccggcaagcaggcccagctgatccagagcgccgtcgacgccaaggtcaacggcatcgccaccaccctggtcaccccggacgccctggccggtgcggtcaagtcggcgaccaccgcgggtatcccggttgtcggcctcaacgccggcatcgaccagtaccagaaactcggcgccctgatgtatttcggttccgatgagtccctggccggcaccagcctcggcaaacgcatcgccggcgagggcgccaagcaccccctgtgcgtgatccaccagaccggttcggtcgccctggaagcccgctgcgccggcgtcaagagcgccgtccccgccaccgagaatctccaggtgaacggcgccgacgacagcgcggtcacgaccaccctgcaggcgaagctggctcaggacaagtcgatcgactacatcgtcaccctcggcgccccggtcgccctggacgcgatcaacgccaaacagcaggcgtcctcggaagccaagctggtcaccttcgacctgaaccaggagatggccaagcgcatcaagaacggcgaggtcgagttcgccatcgaccagcagccctacgtccagggctacatggcggtcacctccctgtacctgtacctgaagaacggcaacgacatcggcggcggccgccccgtcctcaccggtccgtccttcgtggaccagaccaacatcgacaagatcctcccgttcacggagaagaacactcgatgacccctcccactcctcccggaacccccgaccccgcaaaaaccgctgatcccgccggcacccgcgacctcaccgaccatgcccaccacctcactgaccctgcccaccacctcacccaccctgcccaccacctcaccgggtccgcagactcagcccgccagcccgcagactcagcccgccagcccgtgggctcagcccgccatgccacggcgctgggttcccagcccgaaccagcccgtggcacaacccgatcgagggcccggcgagccgcccgcctgctggcgcgacccgaggtcggcgcccttgccgcagccgtcgtcatcttcctgttcttcctcgtggtagctccgtccttccggtccaccgcggcgttcttcacggtcctctaccagtcctccacgatcggcatcgtcgcggtcggcgtaggcctcctcatgatcggcggcgagttcgacctctccgctggcgtcatcaccaccagcgccggcctggtgaactcgatgttctgctggtacttcggcgtcaacctctgggtcggcgccgcgctgtccctggccttctgtctcctcgtcggtttcctcaacggctggctggtgacccgcaccggcatccccagttttctgatcacgctgggcacgttcttcgttctgcagggcgccaacctgggcgtcacgaaactggtcaccggatcggtgtcgagccgcgacatcaccgccatcgacggcttcgcatccctgcagaagctgttcgcctccagcatcaccatcgatttcgccaccatctggatcaccgtcgtgtggtgggccctgttcgtcgccctggccgcgtggactctccagcgcacccggatcggcaactggatctacgctgtcggaggctccgccgggagcgcccgcgccgtcggcgtcccggtgacccgtacgaagatcggtctgttcatgaccgtgtcgttcctcggctggttcatcgggatgcactcgctctaccgcttcaacacgttgcaggccggcaacggcgtcgggaacgaattcctctacatcatcgccgcggtggtcggcggcaccctcctcaccggcggtttcggcaacgctgtaggcgcggccatcggcgctttcatcttcggcatgacaagcctcggcatcgtctacgccggctgggaccccaactggttcaaggccttcctcggcgtcatgctcctgctcgcggttctggtcaacacgtacgtcaaacgcctggccacctccacggccagcttctcctcaaccgcggacacaccacccccacgcgaccgggcgtcgacctctgctcgcccgcccgtgctcgcgggtgccccgccgtccagcgacccggcatcgccttctgcccgcgtcgccgcacaggaggaggactgacgtgaccgacaccctggccgaccacgccgaccgcggtctgcggcgcggcgaactcctgatcgagttgaccggcgtcggtaagacgtacggagcgatccgcgccctgctggacatcgacctacgggtccgggccggtgaggtgacctgcgtgctgggcgacaacggcgcgggcaagtccacgcttatcaagatcatctctggcctgcatccacacacctctggttctctcaaggtcgacggtgccgcccggttcctcggctcgccgcgcgacgcgctcgatctgggaatagccaccgtttaccaggacctcgcggtggtgccgctcatggaggtctggcgcaatttctttcttggctcggaaatcgtctccggtcgtttccccctggctggcatgcgcgtgcgggaaatgcgccgcatcgccgaccgggaactccgcaaaatgggtatcgcggtggctgacatcaatcagcccatcggcaccctgtcgggcggccagcggcagtgtgtcgccatcgcccgcgcagtgtatttcggcgcccgcgtgctgatcctcgacgagcccacggcggcgctcggcgtgaagcagtccggggtggtgctgaagtacatcgccgcagctcgggatgcgggcctcggcgtcatcctgattacccacaacccgcagcacgcctacctggtgggggatcatttcgtgatcctccagcggggcgtggccatcctcgatgccgggcgcggcagcgtcaccctggaggagctgaccacgcagatggccgggggtgacgaactcgcggaactgtcgcgtgaattggagcgccgatcatgatttacctccgcgggaacagcctttgcggtcggccttcatcctgccactccggcaggccacccggaaagggcgatacgcgtccacataaacgtccaccagggacttcgcggagattcccggaccttcggatgagggggagtgcagcatgaccgccctggccgcagtacgcgtcggagtgatcggcaccggcctgatcggccgcgaccacatccgtcggatggcgaccggaatgtccgcgatttcggttgtcgcggtggccgatgtggacctggtcctggcctcccgcgtcgccgcctcggtcggcgccgaggtcttcaccgacggtctcgacctgatcgcctcgccccgggtcgacgccgtcgtcatctgctcctggggccggacccacgagcgatacgtgctggccgcgatcgccgccggcaagccggtcttctgcgagaaaccgctcgccaccagccagcacgcctgcctgcgcatcgtggaggccgaggtcgcgcacggcagccggctggtgcaggtgggttacatgcggcggtacgacccggcctaccgcgcggtgaaacgggtgctggacagtggcgtgatcggcgccccgctgatgatgcactgtgcgcaccgcaacgccggggtgccgtccttctacgagccggagaacacgatcacggacaccgccgtgcacgagatcgacatggtgcgctggatgttcggcgcggaggtgaccgcggtacgcgtgctgcgtccgcgggcgagccggaacgccggcgtcctgcccgacccgtcactgctgcttctcgagcttgcgaacgaggtgctggtggatgtcgaaatctcggtcaacgcccggtacggctacgacatccgcggcgagatccttggcgaggacggcacggtctcgctcggcgatcccgggctgatcgcggtgcgccgggcgggccggctggcgagtcccgtgcccgaggactggcgggagcggttcggcccggcgtacgacatcgaactgcgcgagtgggccgattcgctggtcggcggtggagaggccggcggcccgggcgcgtgggacggctatgccgcctcggtcgtctcggacgcggcggtgcgggcgctgcggaccgcggagcgcatcccggtgagtctggtcgatcggcccaagttgtacgcgttgtcgggctgacgccgcgggtggcggacggttcgcctgcgcgggagtgtcaccgccgacgtcgttggcggcgatgacacccggcctccgggcgaatccgtcccgcgtgcgacgtggcccgcgggagagccgccccgtaaagggttcctgcccgcctggggcaacgttaactcattgttcgtcttgaacgtgttgatcatcggttgtgtctattgtccgaagtccgtcgaaagcgagccggaccacggtgtcggccagcgccccgggccggccgcgatcagggcggtaccactccaccagcgagttgaccatgccgaagagcagacgcgcggcggtcgccgggtccacgtccgcgcggacgcccccttcggcctgggcctgcttgacgagctcggtgaccagcgcgtcgaattcccggcgacgagccagggcgtgctgttcgaccgctgtgttgccgcggacgcggagcagcagcgtgacgaactccaggcgctcggcgagcaccagaacactgctccggaccagcgcctccaggcgtaccgtcgcggatgccggcgcgtcacgcacctgctcggccgcctcgaagaggccgtccaccgcgcgatccaccgccatcccgagcagctgctccttgctgctgacgtggtggtacagggtcgacttggtgatgccgagcgtctccgcgacgtcgaacatgctggtcgcgtcgtacccgtgcgcgttgaacagccggaccgcggcggccagcacggcgtcgacgtcgtggccgggccggccgcggcggcgcggtgcgggctgcgcggtgtccatggagcgaaatatgtcagacctgacgaggagagtaaggcgagggcttgaattaccgaccgaatggttggtaaacatgaggggaccaccgatcgcaacggagcgaacgcatgacgacacccgctgacctgtacgccacccaccgtgagctgcttgagcgcgcgatcgaggcggcctccgcccgcgactactggtccgcctacccggagtcgcccagcaagtcggtgtacggcgaggacgccgcacccgccggcgagcgtgccttcgccgccctgctcggcaaccggttcccgatcgacgtccccggcgccaccggcaccgtgtccaccgagcgctcgccgttcggcatcgagctcggtgtcagctaccccaaggccgacccgctcgccctggtcgccgccgcccgcgccaccatcccgtcctggcgcgccgtcggcccgcagggccgggccgggatcgccgccgagatcctgcgccggatcaacgcgcgcatcttcgagatggcgcacgccgtccagcacacctcggggcaggcgttcgtgatggccttccaggccggcggcgcccacgcgcaggaccgtgcactggaggccatcgcctatgcgctggccgccaccacccgcatgcccagcacctcgtcctgggccaagccgcagcgcggcggtgacccgctgagcatgaccaagaccggcaccgtcgtcggccgcggtgtcgccctggtgatcggctgcaccaccttcccgacgtggaacagctaccccggcctgttcgccagcctggtcaccggcaacccggtcatcgtcaagccgcacccgggcgcggtcctgccgctcgccatcaccgtgcagatctgccgggaggtcctgaccgaggccgggctgaacccggacgtcgtcacgctcgccgtggaggagccgggtgacggcatcgccgccaccctcgccacgcatcccgacgtgcggatcgtcgacttcaccggctccagcgagttcggcgactggctcgaggcgaacgcgcggcaggccgtcgtctacaccgagaaggccgggctcaacacggtcctgctcgactccaccgacgactaccgcggcctgctgcgcaacctggccttctcgctctcgctctacagcggccagatgtgcaccaccccgcagaatcttctgatcccccgcgacggcatcgacacggaagccggccgtcgcaccccgcaggagttcggcgcggacctggccaccgcgctcggcaagctgctcggcgatccgaaacgggcggccggcactctcggcgcgatcgtcaacgacggcgtgctggcccggctcaccgaggcggccgggtcgcccggcgtggtgcacccgtccaccgaggtcaccgacgagcagttcccgggcgccaccatccggacgccggtggtgctgagcctggacgccgccgacgacaagacctacacccgcgagtggttcgggccggtctcgttcctgatcaccaccgactccaccgagcacagcctgcgggtgttcaccgagacggtgcgggcgcacggcgcgctgaccgcgctggtccactccacgtcgtccgaggtgctcgcggccgctcgggaagcggcgctggatgccggcgtgcacctctcggagaacctgaccggcggcgtcttcgtgaaccagacggcggcgttcagcgacctgcacggcaccggagcgaacccggccgcgaccgcctcgctgaccgacgactacttcgtgagcggccggttcttcaccctccagtcccgccaccacgtgccggcggcgacgtcatgagcggtgaggagaccttcgccgacacgatcgcgcgggatcagcgtgtcgagccacgggactggatgccggacggataccgccagaccctgatccggcagatcgcccagcacgcccactccgagatcatcggtatgcaaccggagggcgattggatcacccgcgccccgacgttgcggcgcaaggcgatcctgctggcaaaggtgcaggacgaggccggtcatgggctctacctttattcggctgccgagacgctcggcgccgaccggggcgatctgacccggcggctgatcgagggtcggcagaagtattcgtcgatcttcaactatccgacgctgagcttcgccgacgtcggggtgatcggctggctcgtcgacggcgccgccatctgcaaccaggtgccgctgtgccgcagttcctacgggccctacgcccgggccatgatccggatctgcaaggaggagtccttccaccagcggcagggctacgagttgctgatgaccatgatgggcggcaccccggcccagcgggacatggtgcaggatgcggtgaaccgctggtggtggccctcgctgatgatgttcggcccgcccgacggtgactcaccgaactcggcccgctcgatggcgtggaaaatcaagcggcacagcaacgacgagctgcgccagcggttcgtcgacatgagtgtgccgcaggccgaggcgctcggcgtcaccctgcccgactccgagctgcggtggaacgccgaccgggagcactacgacttcggtgagcccgactgggctgagctgaaacgcgtgatcaccggtgatgggccgctcaaccggcagcggatcgcgcggcgccggcaggcggataccgacggggcctgggtgcgcgaagccgccgcggcgcacgcggcgaaacagaccgggagcgggcgatgagcgacgatgtacgccacgagtggccgctgttcgaggtgttcgtgcgggccaagcgcggcctcaaccacgtgcatgtcggctcgctgcgggccgccgaccaccggatggctctgcagcacgcgcgggatctgtacacccggcgcaacgagggggtcagcatctgggtcgtgctctccgacgacgtggtggccagcgaccccgatgacaaggcggcgtatttcgagccgagcgccgacaaggtgtatcggcatccgacgtactacgccatccccgactcggtgccgcacatctgaggtgaccatggccttcgacgacgcgtacggtgcgctcaccgatcatgacgacgacgcccgctgggcgtatgggaccggcttcaccgaccccctcgccggggtgcccgccgcgttccccgacggggtggatcggggcgacctggccacctactgcctgatgctcggcgacgacgcgctgatcatgtcccaccggttgcagcagtgggtcacccgtgctcccgagctcgaggacgaactggcgctggccaacatcggactggacctgctcgggcaggcccggctgctgctgacccgggccggggaggccgggggtggcgggcatgacgaggacgcgctggcctaccaccgtgacccgcacgagttccgcaacgtgcggttggcggaacgggccgacggcgacttcgcccagctgaccgcccggctgctggtcttcgcgacctggcggctggcgctcttcgaccggctcgccgcctcccgcgacccgatgctggccgcgatcgccgccaagggggtcaaggagctgacctatcaccgggactacgccgcgcagtgggtggtccggctcggcgacggcaccccgctgtcgcacgaccggatgaccgcggcgatgaccggggtgctctcagcggccggcgagctgttccgcccgcacgaggtcgaggcgcggctggcggccgacggcgtcgccgtcgacccggccacccttcgtgccgagttcgacatggtgctcgccgaggtgctggccgcggcgacgatcgacgccggctcggtgacggacgacgacgaggccgctggccagggccgcgacggcgcacacaccacggccctcggcgagatcctcgccgaaatgcaggagctggcccgtgctgtccccggaggtacgtggtgaccaccgtccgtcacctcaccgcctcgggcctgcgcgggccccgcagatgcgatggccgtcgctctgaccgtggcgtgcgcgggccgcggagttgcggtgaccatcgctccgactgtggcgtgcgcgggccgcggagttgcggtgaccatcgctccgaccgtggcgtgcgcgggcctcgaggttgcggtgaccatcgctccgaccgtggtctgcgcgggcctcgaggatggggtgaccatcgcactgttcagggtctgagcgaggcccacgggtgcgatgaccgtcgcttcacacggcgcgctgtgatgggcgcgccggctggtgttctcgcgggcggccggcgatgaacgccgagctggtcgtcggcaccgtcaccgacccggagctgccgatggtgaccctggccgagctggggatcgtgcgcgaggtccggcaggacggtgacggtgtggtcgtgacgatcaccccgacctattcgggctgccccgccatggaggcgatccgcgccgacatcgctacggcgctgcgccgggccggcttcgggccggtcgaggtgcgcaccgtgctggcgccggcctggaccaccgactggatcagtgagtccggccgccgcaagctcgccgaggccggcatcgcgccaccgggggccgcgcctcgccgggcgggcgggccgatcccgctcaccctcacgccgcggtccggcgccgtcccgtgtccgcgctgcggctcggcggagaccgaagcggtcgccgcgttcggcgccaccgcctgccgggagttgcgtcgatgcccggcctgccgggagccgttcgaacacatgaaggagatctgacgtggcgatcagcggtttccacacgctgcgggtcgccgcggtcgatcggctgtgcccggacgcggtcgcggtgaccctggccgtgccgcccgagctgaccgagcgattcgcgttccggcccggtcagtcgctgacggtccagcgggccggcgaacgccgaacgtattcgatctgcgcccccgccggcggcgcgccccggatcggtgtgcgcgaggtgcccggcggccggatttccggctggatcgtgcacgacctgcgcgtcggtgacgagttggaggtggcgccgccgtccgggacgttcacccccgatctcacggcgggcgggcggcacgtgttgatcgcggccggctccggcatcaccccgatgctgtcgatcgccgcgtccctgctgcgtcggccggatgccgaggtcgtcctgctctacggcaaccgccggaccgacacggtgatgttcgccgaggaactcgccgacctgaaagaccgctatccggcccggctggagctggtccacgtgttgtcccgggagccccgggaggccgacctgttctccggtcgcctcgacgcggcccggctgcgggcactgctgccgctgctgatcgacgtcccggcggtcgaccactggtggctgtgcggcccgttcgggatggtcgtcgacgccactgaagtgttgagcgaggccggggtcgcacccgagcgcatccaccgagagttgttctgggccgacgaggcgccgcccgagccggttcgccccgagccggagtcccgcggcccgagcagcgagatcaccgtccacctggacggccgcgcgaccacggtcaccgtcgaacagggcgtaaccctgctggacggcgtccagcgcgcccggcccgacctgccgttcgcctgcaagggcggcgtctgcggcacctgccgagcccgcgtcatcgaaggcgacgtcgccatgcgccgcaacttcgccctggaagacgccgagttggccgccggcttcgtcctcacctgccagagcacggccacttccccgaaagtggtggtcgatttcgacgaataacccgccaggtcccccagcgcagccgccagcccgctgaccccgccgcttgcttcctgcgggtcgtgagccagcctgtggcgggttgtcggtttgctccgcgcgggttgcgggttgtgtgttcgcgtggggcgggttgtcggtttgctccgcgcgggttgcgggttgtgtgtccgcgtggggcgggttgtcggtctgctccgcgcgcgttgcgggttgtgcgtccgtgcgggacgggaaggcgtcacccggctgattcccgggtgatcattcttctactgtggagtctgggcggggtagcgttcgcgcatggaggttttcgatcaactcgctgagaagtatcagggcgagcacagccataatccctaccagtcggcgctgatcgagaagatcggcaccctgcttccggccggcacctcggtgctcgacctgggctgcggcaccggggtgccgaccgcccgcgttctgaccgagtcggatcaccgcgttgtcggtgtggacattgccgagggcatgctgcggctggcccgtgagcaggtgcccgcggccgagttcgtgcatgccaacttcgccgagctgccggcggatttcggcaggttcgaggcggtcaccgcgttcttctcgctgctcatgctcagcaaggcggacatcgaacgcaccctcgacaagatcgcgggctggctgcagccgggcggatacttcgcgatcggcatggtcaacttcgacgcggacagcatcccgatcgaattcatgggagtgccggtgaccgtttccggctacctggagccggacctcagggcggtcctggaaaagcacggcttcgaggtcgcaacgatcgagacggtgttcttcacgccgaccgacgggccgcaggagagccagatcttcgccctcgccaagctccggccctgaccatcaaaggcgataaaacctcaaaatccgattcggccgtacgggtcgggacgacgcctgtcgtctcgacccggcccttcatgcggtcacctcgtgaacgccggacatgtgcggcgaccgtggggggcgggacgcgaaagggcggtcaggcggcccggcggaactcgttgagttcacgggcctcggcggcatagcgggcgagcaggtgcaccgtctccggcccggcggtgccgtcggtgtccaggccgacccgggcctggaaggcgagcaccgcctgggtcaggtccgccggttccgggccgaccgtgacgccgaagtcggcgaacagggtgcgcaggctcgccgggtcggcggacggtgtgctttccggccagccgatcagaccgccgacggcggtgccgaccatggtgagcattcctcgagcggtcatggttgcctccccgattcgctgtgtgcttccagcttcgggttttccgctgtgtacgacatctgccgagggtctcgatcggctgtggtcgcctccgacttttggccgggtggagccggggccgtgcgagcctacggacagagggcggcccgggccacgtcggtcagtttgcgggcctgttcgggggatacgccgtacgcggcaagatcgtcatgttcttgaccgtgtgccgacgcgcaggccgtgctgcccagatcggcgatctcctcgtcccggcgatccacggctagttcgggcagttcctgacggacggcagcgacgaagcgatcctggttgtcggcgggcggcggggcgctcgcggcgggatgggcgcggccctgcacccacacggcgtccgagtgggagcatcccgcggtggagcccagcaccagcatgacaaaaccgatggagcaggcgatacgaccggaattcaccggaaagaccgtatggcacccggggcggtcggcgaccgcgacgcaccgactcggacgggggacccccgcggagcatgatccgaggcaggcggtgaaggccggggccgtcaggcgtggcggggtcggggcggcgccgtggtgatggccgggcggtgggcgtggcgggggtcaaagcggtgccggtgatggctgggcggtgggcgtagcgggggtagggtgatcgctgggcggtgggcgtggccgggggtcgggcagcgccgtggtgatggctgggcggtgggcgtagcgggggtcgggtgatcgctgggcggtgggcgtggccgggggtccggcagcgccgtggtggcgacaggggcgatggcgtacagcgaagtcacagaccgctcaccggttcgggacaatctccgggaacaccgtgaagaacatgaccgagccgctgaaccgttccgccgccgagcatcaccacgtaccgtcgtcgttctacccgcccgtcacgcacatcccgccggcgatggtgcggaccccggccgacccgcgttggaagcgccggatcgccggcggcgccgcggtcctggtcctggtcctggtcggcggtggcagcagtgccggagcgttcctgaccgagcagtacctgaacgggcgcccggccacggcgagcagcatctccgggacgaccgtggcctccaccacgatcaccgagggtgacgagctggcgccgatcgtcgcgaaggtgcggccgagcgtggtgaccgtgctggtcgacggggcgcgcgaatcgtcgctcggctccggtgtggtggtcagcgccgacgggctgatcctcaccaaccatcacgtgatctcttcgaacggcacggtcagcgtgcgcctgtccaccggcacgacggtgccggccaaagtggtggccgcggacccgacgcacgacctggcgctggtgcaggcgaccggggtgtccgggctgaccccggtgaccttcgcgaccgacgacagcgtggcggtcggtgacacggtgctggccttcggcgccccgctcggccttgaggggacggtgacctcggggatcgtgtccgccttcggccgcagcctggacaccggtgccgagaagctctccggcctgctgcagaccgacgcgccgatcaacgagggcaactccggcggtgcgctggtcgacacggccggccgggtgatcgggatcaacgtcgccatcgccacgtcgggggacagcaccggcagcgtcgggctcggcttcgcgatcccggccgatacggtcaccggggtggtccgtcagcttcagacccgggccgccggctgaaccgcggtgcgccggcttcagaaccagaccgccggctgaaccgcggtgcgccggctccagatccaggtcgtgtcctgaacccgcagtgtgcctgctccagcccacagttgatccccgaggcgatgggagcggaagcggcggacaaaaggcgcgccgccggaaacgccgcggggaaggcgctgccaggtgaggcgcggcggggcggcgggaggaaggcgcggcgggggaatgatggtgcggggaaacgccgcgggacggcggtctggtcagggcgcgacagaaggagcgtgcggcgggcggtgagcggcgtggggaaacgccgggcgaggcggtccggggcggtgaggcggggcggtgaggcggggcggtgaggcggggcggtgaggcggggcggtgaggcggggcggtgaggcgggggtgtgaggcggggcggtgaggcggtgagggaacgccccgcaccccgcaccgccccggcgtcagccgatcagccggccaggtgaccccaccggtcctccagctcggcccacgtcccctgatcctcggccttccccccgatcagcaccaccacccgatccgcctgcgccagcgcggcccgcttggacgtcgagcccaccaccgtcaccccatgcgaccgcagcgcccgccacagttccagctccgtcgtcacgtccagggccgacgacacgtcgtcggcgatcagcagctcggtccgcggcgccagcgcgcgggccagggcgaggcgctggagctgaccgccggagagccgggttcccttgtggccgatcagcagctgcagcccaccgccggccgcggacaggtcgtgccgcagctgcgccacggtcacggcgtcctcggcgtccacctcgtggccgaggcggatgttgtcggccacggtgccggaaagcacccgggggagctgcgcgacgtaccccacctggttgggtcgcaggaagagttccggctcgttcaccggttcgccgttccagcacaggtcgccggtgtggtgcacgatcccggcgagggcccgcagcagggacgacttgcccgatccgaccgggccgacgaccagcaccaggtcgccgcggtcgacggtcaggtcgatgtcgcgtacgccttgggcgccgttttcgtggacggcgctgaagccgcgcagctgcagggtgcgcagcgggttgcgcgccgcggccgccggtgccggcgcggtgccggcggagatgtcgacgcccgggatctcggcggtgtattcggcggagccggtcatcgcgacggtccgcgccgtccacacccgggccgacgggaagtgtgacaccagcgacgccgtggtccacgcgaaccagcgggccgagccgagggtggcgaccgcgaccagggtggccgcggcgctgagccggtcggtgaggtacagcgaccagacgccgatcggcagcaggccgctggcgatcgacggggtggaccgcgcccacacctggatcgcgatctcccgccactgcagttcgctgcgccgggcgtcaagtttggccaggtgggcgagcaccggttcggtcgcgccggccagtttcaccgtgcgtgccgcggacagtgcggacaccagcgcggtcgcgaacgcggcgcgggcccccacggtgcgccgggccgcctgttccaggcgcggcccgaacagggtggcggccaggccggacagcagcatggtgccgacgaagaacagggccggcaccggcgagcgcgaggtcagggtcatggcgaccacgacgacgagcgccaccccgttgtcgatcagattgtcggccagcatcaccacccgctcggtgtcgccgccctgggcgaccacctcggccggggtgtgcttgctgacccggcgcggcccgatctgcccgtgcaccaggcgcaggctgatccgcagcatctgccgcacccaccattccgggaaccaggccccggtgaagtagagggtcgggatcagcgcgatcaggcaggcggcgatcccgacggcgggcagcatcgggttgccgaccccgtcgaccacccgggaccacagcaccggcaggaccgcgccgtcgagcccgaagaccacgaggaagacgaagagcgagaccgcgcccagcccgtaccgcgcgtcgttggtggcgagccggacgatctcccgcatcgtccgggttcgcggcggggtgggcagcggaggcggctcgacggtcggcagcgggttgctgagcgcgtccgggccgagttcgagccggacagcggcgtcccagtcatggcgttcctcgacgagcacgccgccggaccggtctcgggccggcgccggcacggtcaggttgctgctggccatgagctcggcgaagcgacgcgattcgcgcaacgggccggcttcgagcacttcgccgtcggcgagcaccaccacctcgtcgcagcgttgcaccgaggagagccggtgcgcgacgatcaccccgatccggccgcgcagcagccggtcggtggcctgctgcacccacgactcggtgaccgggtccatccgggcggtggcctcgtcgaggatcaccacctgcgggtcgcggaccaggatccgggcgaacgccaccagttgctcctgcccggcggacagcttgtagccgccctcgccgagccgggtgccgatgccgtccggcagcccggcgacccagctgctcaaaccgagttcgtcgagggccgcgccggcccggggcagtaggtcctcgtcgaagagcgcgatgttctcggccagggtgccggccaggatctcggtgcgttgcgggacgatcgcggtccaccggcgcaggccttcgacgtcgaggtcgttcaggtcgacgccgccgaggaagaccgtgccgggcggcacgtcgacggcccgggtcagcaccttggccagggtggacttgccggatccggtgcggccgatcaacgtgtacgaccggccgcgggcgaaggtgagggtgacgccgcgcagcgccggcgggcggccgctgtccgcctcgccgtagcggaaggtcaggtcacgcacgatcaggtcgccgtcggcgggcgcccggccaccggacggctcctgcggcacggcgcgcagcatctgcacccggccccaggcgccgagcgcgttctgcagctcgggcaccatccgggtgatctgttccagggtgccgccgaagcccagggcgagcagccacacgccggtcagccgggcgccgtcgatgtgcccggtggccagcgcccaggcgccgaccacgacgagcgaggcgatcagcgtgcgggtgatggtgccggcgcccatggtgacccgggacgaggtgcgccagacgcggcggccacgggagagcacctcgcgggcccggtcggcgtacaggcgcagcacgtacggcgcggcgaggctggtgcgcacgtcgtcctgcccgtggatcgcctcctccatcaccgcggccaggtcggaccaggcctcctcctcggcgatccggatggcggagatgcgctggatcggcttgttcatggtgatgaagatcaggacggcgaccgcgatcatggcgaggccggccggccaccagacgaagaacgcggtgacgatcgacagggtcgccacggccaggctctgcgcgatccgcacgccgctgccgcgcagctcggaggcgacctggtagacgtccgagtcgatccggtcgagcagctcgccgaccggcgtgttctccagggtggggatgtcctggccgaaggcgacccggttgagcccgcggcggacctcggcggcccagtcggcggtcagccgggcggcgatcaggccgaccacgacgtcgctgagcacgatcgcgccgagtgccccggccagcacggtgaacagcaggacggagcggtcgaccaggaccgatccggcgagcgccagcgcgacggacgagccggcggcgccgagcacgatcaggaacacggcgagcgccgtgcgacttcgggaggtaacccacaggtcgcggagcaggcgcatgagaaagtcctctggagcgatggggtggcaggcggtatcccatcctccgttggcccggtggaacgactcaaccggtttattcggcagtgatcatgatctccgccgctgccgggtcactccgccgagcgcagggtgagcaccgtgatctcgctgggcgcgaagatccggaacggcgggccccagaaaccggtgccccggctggtgtagagctgggtgcggtcgccgtgccgggacagtccctgcaggaccggctggtcgatgcggaccaggtagtggaacggccacatctgcccgccgtgggtgtgcccggacagctgcaggtcgatgccgtgcgccacagcgccgtcgatctgctgcggctggtgggccagcagcaggacgggcagggtcgggtcggcgccggccagggcggcctcgtggtcggcgtggtgcccggggacgccggagccggccgcggtgcggtcgtcgacgcccgccacgaccagcgagtcgccgccgcgggtgacgaccaggtggcggttgtgcagggcgtcccagcccagcgacgacatgtactcgacccagccggcggcgccggacatgtactcgtggttgccggtgacgtagacccgggccatcgatgcccggacgtcgccgagcggggcggcctgggcgagccgctgcgggacctcgccgtcggcgatgtcgccggtgtgcgccacgatgtccggtcgcagcgagttgaccacgtcgatcaccccgcgcgaccagcgggaccggtcgatcgggccgtagtgggtgtcggtgatcagcaccacccgcagcccgtccagcccgcggccgagccgggagatggtgacgtcgaccgcgcggacccgggagacccgcatcgcctcgcggtggccccagagcagcaggaccgcggagatcgccaggaccagcccggtgaccagccgggaacggatcgggtcggcgaccccggcgagggccagcaccaggccgagcagctggccgagcaccgaccaggtgaacagcacccagaccacgcccagggtggtgtcggcgatccgcgagctgcggtcgtcacggcggccgtgaccgcggaacatcaggaccgggaaagccgccgccaccagcacgaacaccaccgtgccggcgatccggaccggggccggccaagcgttgcccgaccagagcagcgtggcccacggcacgccgaagagcagcgcgagcaccgcgaccagaatgacaccgaaccgggcgcccgcccgccggcgtcgcggccgcgccgcgaccgccgcctcttccactgacatgcagacaagcatgccaccggcctacgacactctccccagcgttctcagcagcgcggacggcaccacgagatcggcccggtcccgggtggtggcgatcagctcggcgttgcgctcgtcggtcccggtcgcccaggtcagcgcgtcctccggcgacttgccgaaccgaacgtgccgggccaccaggcgacgcagccgttcggccggctccagatcggcataccagacttcgctgaacactccggacagtcccgcccaccggccgtcctcgagcagcaggtagtttccctcggtgatgaccagccgggcggcgcgggacaccccgatcgtccccgcgatgggctgttccaggacccgttcgaatcccggcgcgtacaccatctcgtcctgatcggcgagaatccgccgcagcaccgacgcgtatccccagccgtcgaaggtgtccggcgcgcccttgcgatcgcgcctgcccagccgctccagctccacgtcggccaggtggaacccgtccatcggcacgtgcgccacctcgtcacccgggcccagcgccgccagcagcgactcggccagggtggtcttcccggcgcccggcggcccggtgatccccagcaccgcgcgccgcccgccggccaccagcccgcgggcccgatccaccaactccggaaacgtgctctccatgacggcgacgctagccgccgcacgggtcaaccgacgatgtcggcgtacgccgtgctcagcccagcccgagtcgcagccccgccacgccggccggcgacagtggccgggcggtggcccgcgccaggtcgtcccgcaccccggcgggcagttcgtcgccgagcgcgcagagcaccgggtagagatcgagcacctgccggtggctgagcgccccggccccgatcagcagcccgttcagcgcgatcggcgtctggcccagttcgccgcagagctcggcccgccaggccgggtcgtgcacgtggtcggcgaattcgcgggcgatccggttcccggccggggagcgcagcccgccgagggtgttctgccgcagccggctgatcggcggcgctagccggcaggcgatgccgagccggcgggccagctgcggaacggtgagcacgtccatcccggccgcgcagccctcgcagagccgctggtaggtcttggcgtggatgaccgacgcgggccgctggcacgcgccgtcgaggccgcaggacgggtcgaggatcacctcggtgagggtgccctcgtggtcgaagcggccgaccgcgaagtaggtggccggggcggtgcggtagcgggccagggcggcgcgggcgctgacgtagccgtccgggtcgacgccgatctgtggcacaccggcctcggtgtgcagctggatgagccggaacatggtgcacgctcccggggggtgatgcgaacggcgaagcgttgtcgcgttgtcgtctcgctcccgggtacgcgcaccggcggggaaaagttcagtcactacacacagttagtgatccgtgacgagatacgcgctggcaggcgtcctgggagcaagcgaaggttactcccagtcacgtgaaatggctaggcctcgcgggttctggcatgctggtcggcgtgcgtaccggtcagggggtggcctgtgtctgcgggcacccgttcgaggctcatcagcactaccgcgccggcaccgagtgcgtgatctgcgcgccgcgcgagtgtgcccgcttccgccgcacccgctggtggcgccgctggaccgcgggccgtgccgtttaggggtcgacgggggatgcgaaagtctataagttctgtaggcttaccacactttgaagtgacccctttgaagtgaggacaccgatggcacttcccgacttcctgatcgccggtgtgcccaaggccggcaccacggccctgcacgcggcactggtgcaccaccccgacctgttcctgtcgccggtcaaggagcccaagttcttcctctccgacgggccgccgccgcggcacggcggtccgggtgacgtgcagacctaccaggagcacgtctggcggcgcgaggactacgaggcgctgttcgcgcccgcgccggccggcgccagactgggcgaggccacgccgttctacctgcacgacctcggcgcgcacgaccgcatcaaggcggtgcggccggacgtacggctgattctgcttctgcgtgatcccgtcgatcgggcgcactcgaactggacccacctgtggaacgccggcctggagcccgaggccgacttcctggccgcgtgccgggccgagcccgcccggatcgaggccggctgggcgcagttctggcactacctgggcctggggttgtacggccggcagctggagcacctctaccagcgcttcccgcgcgagcaggtgctgctgctgcgctacaaggagctcaaggacgcgccggcggccaccctggaccgggtctgcgcgttcctcggcgtgcgcaccgggctgctcaccgcgatcccgaaggagaacgtcaaccggcacgtcgtggaggacaacggactgaaccgggtgctgcgcgggctgctgcgcgccggcggcggtttcggtcagcacttcccggtgccgctgcggctggccgcccgcggcccgctgctcaccctgctgcaccgcaagaagggtgcgcgcccggtgaccaccccggccgagcgggcggagctgctgccctacttcgccgaggacatcgcgctgctgcaggacatcaccggcgagcggtacgacgactggctcagtgtggaccgacacgcccgcgcgccggaaaccccacccgttcaataggttatgcgaagattgcccggtacgccctatctctccaggagcgcgaacgtgtctgtcggaaccaccgccctgcccctgccccgctgggaagactccaccgtggtcgtggagccgccgggcaccgagccgggtgcgtggtccggcgcgcccagtgcgatcgccgccgacgggcacatctacctggcgtaccgggtgcgcctgccgatcggcgccggccgcgggatcgccaacgtgatcgcccgctccgccgacgggctcgccttcaccgtggtcgccgaagtgggcaaggaccggttcgccgccgagtcgctggaacgcccggcgctggtccgcaccccgcaggggcggtggcggctgtacgtcagcgcggccaccccggggaccaagcactggcgcatcgagatggtcgaggcggacaccccggagggtctggccgcggcgccggcccggaccgtgctggccggtgacgccgagttcggctggaaggacccggtgctgcaccacgacgggcacggctggcacctgtgggcctcggtgcacccgctggagtcctgggacgacgccgaccggatgaccaccgagtacgcgaccagcccggacggcgtgcactggacccggcggcggaccgcgctgtccggccgggcgggccggtgggacgcccgcggggtgcgggtgtcgtcggtgtcggtgaccggcgacgacatcaccgtggcctacgacggccgggcgaccgcgggggagaactgggaggagcgcaccggggtggcccgcggccggcggctcgccgacggcagcttcggggagctgaccgccgaggacgacgagccggtcggcagcccgcacccgccgtacgggctgcgttacgtgagtctggtcgatctgccggacggcacccgccggctgtactacgaggccacccgggaggacggggcgcacgacctgcgtaccgaacgggtgtaggaaagatcttcgcggtttgcgcaggcaccactcgggtatcgccgtctgcagggcggagggagttctgtgcgcacgctgggcggccggtatcggctggagcaccggatcgggctgggcggcatgtccgaagtgtggcgtggccacgaccaggtgctggaccgcccggtcgcgatcaagatcatggcacccgcggtggagggcacgctcggtcagaccggtgtcgacctgatccgggccgaggcccgctcggcggcccggctggcccacccgaacgtggccggcgtgcacgatttcggcacctcgccggcacccggtcggcgcgacgtcccgtacatcgtgatggagctggtcgaggggcagacgctcagccagcacctggccggcggccggctcgactggcggatcggggtgcggatctgcgccgaggtggccgccgccctggccgccgcgcacgccgagcaggtggtgcaccgcgacatcaagccggccaacgtgatgctcaccccgagcggcgccaaggtgctcgacttcggcatcgcggcggcggtcggcgcacccgagccggacaccggcgggatggtgatgggcaccccggcctacgtcgccccggaacgcttcgacgggatgccggccaccccggcctcggacatgttcggcctgggctcgctgctctaccactgcctggccggccgggtgccgtggaccacccgctcgcccaccgagctgatccgcgcccagcgctaccacgacccggagccgctgccgagcctggacggactgccgcccgaggttctcgacctgtgtttccgctgcctgcgccgggacccggcggagcggccgaccgcactggtcgcggcgctgctgctggccgaggcggtggacgcccgggtgtacgtgccgatgatggagatgaaaccggtggtgccggcctgggaccggaccgccgccgaggccgcgacgtatgccggcccgcaggagcaggccgcgacgtatggcggcctccagcagcaggccgcgacgtatgccggcccgcaggagcacgcgggccggcaccgcctcgactagtccgcccgctccagacgtacccgggagtgccggtagccgtacagcccgtagatgatcagaccggccaccagccagacgccgaaccgcagccaggtggccccgggcaggtcgctcatcaggtagacggcgaacgcgacaccgatcaggggcagcaccggcgaccacggcacccggtacggccggggcatctccgggcgggtccggcgcagcacgatcaccccgatgttgaccagcacgaaggcgaacagggtgccgatgttgaccagttccacgatggtgcccagcgggaccagcgcggccaggatcgcgatcagcacgccgagcgtgacggtgatccgggccggggtgccgaaccgcgggtggacggtggccatccggcgcggcagcaggccgtcgcggcacatggcgaagaagatccgggtctggccgaagaagatcaccagcaccacgctggtgatcgcgaccaccgcgcccagtgccaggatcccggccgcccagctcatcccggcgccctggtcgagggcggccgcgagcggggcgtcgctgtccttcatctggtccgggctggcgatgccgagcgccccgatcgcggtgagcacgtagaagaccgtgcagatggcgagcgagccgatgatcgcccagggcaggtcgcgcgacgggttacgggcctcctcgctgccggtggagacggcgtcgaagccgatgtaggcgaagaagatgatcgccgcggccgcggtcaccccgtgcgtgccgtgcggggcgaacgggtggaagtgccgcgtgctgaagttggcgaacgccaccaccaggaagaagatcagcaccaccagcttgaccaccaccatgaccaggttggcccgggcgctctcggtcacgccgcgcaccagcaggagggtgatcgccagcacgacgaagacggccggcaggttgaccaccccgccctcgccgggggacttggcgatcgtgtccggcaggctgaccccgaacgcggcgtccaggaacgcgttgaggttgccgccccagccgatcgcgatgccggccaccgagacgccgtactccaggatcaggtcccagccgatgatccaggcgacgagctcgcccatggtggcgtaggtgtaggtgtacgcgctgcccgagaccgggatcgaggacgccagctcggcgtacgacagcgcggagaacacgcaggccaccgcagcgagcacgaaggacagtacgacggccgggccggcgatgcccgagcccttgccgatcaccacgaagatgccggtgccgatgatcgcgccgacgcccatcgcggtcagctgggtgaccccgaccgccttcttgagctcggtgccctcctcggcggtgtcctgcaccagcgatccgacgtcgcggatcgcgaacaaccctggtctggccatgccgttcccccttcgacgagtctgatcacgtcatcccgcgttcacctgtccgccaagcggcatgccgaacggttcggcgcgatgcgggaatctgtgccgtccgggttgccggatgccccgtccggtgggtgaaatccggcccgggcgtacgcggtgtgcggcgaggtcgggaaaccgcgcgccagcctgcgagcgggacatcgggaccggtacggtggagagatcgggcaaatcgcccgactcggaatatcagtgggcgaggtcgtcatgggtgaggccgtgatcaccacgcggcggcaggccgacggcgccctggtcgtcgaggtgcgcggcagcctggacgcggcgaccgtcgacgggctgcgtgccaccctcgtcgacaccgtgctgcgcgaccgtccggccgtcgtcgtcgtcgatctgacctatgtgaccttcatggactcggtcggcctcggcgccctggtcgccggcgagcggacggtccgcgacatcggcggccggttccggctgcgcaaccccagcgagttcgtgcatcgccagctccgggtcaccggcctggccgagttgctcggcgtcagcttcggtttctgaagcctttcccagcccggaattccagccgttcgccctattcccgggcaggtggctttcggtcgaccattattgccgggtgacgaataccgcccgagcaggggacagaatctgaatcttctttgtgatagcgtcctgtgccgccgctgtggaagttacggggattgattttctactcgggtgcacctcccggagatcactatgcccgaaatgtgccgcggcatttgtcggcatgtgaaaggtggatctgttgccctcgtctcgtcgttccgtcgtcaaggcgggagtgttcggcgcggtggccctcggcggcggtctgagcgccacccgccccaccacctcgcaggtcagcgccaccatcctggagaaccggttccagggcaacaagggctggctgccgcaggagaacgtgaacgacgccgcccggcagatccagggcttcgcctccgcgacctcggtcaacaagggcgacacgatcgacttccacgtcaccctcgcgacgccgcagcacttcaccgtccagctgttccggctcggtcactaccggggcgtcgggggccggctggtgcacaccagccccaacctgtccggcagcacgagggtggtgcccacggtggacccggtcaccggaacggtggactgcggtgactggcccgcggcgtactcgttcaaggtcccgccgggctgggtctccggtctctacctcgcggtcttccgcacccaggacgggcaccgctcggtcaccccgttcgtggtgcgcgacgacagccgccgctccgacttcgtcatggtggtgccgttcaccacctacaacgcgtacaacgtgtggccggccgacggccgtaacggcaagagcctgtacaagggctaccggccggacggcctgatgggcgacgccacccagcgggcgtacgaggtgtccttcaatcgtccgttctccggtgggggccgtcccacctggttcgacatcgacgtcgccaccgcgcagtggatggagtcgcagcggtacgacgtcacctatgtcagcagcatcgacctgcacgagggccgggtcgaccccagccggcaccgggcgctgatcttctccgggcacgacgagtactggaccgcttccatgcgggacgtcgtgcagaaggcgatcaccggcaacacccacgtcgcgttcctggcggcgaacaacctgtactggaacatccggatcgaggcggacgcgcgcggcacctccggccggatcgtcacctgctacaagggtgcgcccgacccggcgcccgacccgatcggcgagaccaccctgtggcgcaacctgggcaccggccaggagcacgccgaggcccggctgctcggcgtgcagtacaggggcatcctggccaccccggtcccgatggtcgtgcagaacacccagcactggctgtgggccggcaccggtctcaaggacggcgacacgatccgggacctggtggcggtcgaggcggacggcttcgagtcggatctgccgaccgactacgagtcgacccagacgctgctgtccgccagcccgtacaccgaccggatgggccgcggcgaccgggtgcagaacaccagcgtctgcgagacgccgaacggcaccatcatgttcgtcgccggcaccttccactggccgctcgcgctggtcaagtcgaaggtgaccgacgcccgcatccagcgcgccaccaagaacctgttcgatcgcttcctgaggtagtccgcccgggtcagaccgacaccggccgggcccgggatcccgcggcgaccagcagggaccgcggtccgcggatgatgctggcgtcgcggcgccgcagccggccggcccgccgcaggtcgggcatccgttcggcgagcatccgcagcgcgaccccggcctccaggcgggccagcggcgcacccacgcagtagtggatgccgctggagaaggccaggtgatcggcctccggcacgcgccggatgtcgaagcggtccgcgtccgcgtacaccgccgggtcccggttggccccgccgagcaggcagacgacgaactggccgcgccgtaccgtacggcctgccacctcgacatcctcgcgcgcgcagcgcgccgtacgctgcaccggcgagtcccagcgcagcgtctcctcgaccgccgcatcggccagcccggccgggtcggcggccagcgcggcccactgatccgggtggtcgagcagcgcgttgaccgcgttgccgatcaggttgacggtggtctcgaagcccgccacgagcagcagccggcacatcggcagcaattcgtgtgactggatctgatcaccctcggcggccaggatccggcttaccgcgtcgtccgccggctcccggcggcgcagcgcgaacagccggatgaacacgtcgtccatcgcgttgctggcggcgatcagcgcggccgcgtgccgcagcgaacggaccccgtcgagggcgctgccgaccaccgcgccgtgctcggcgaacgcgtcggcgtccgcgtccgggatgcccagcaggtcggagatcaccgcgatcggcagcggcgcggcgaactcgctcaccaggtcgaaggtgcccttggcggcggccgcgtcgagcaggtcgccgaccacctgctcgacccgcgggcggtaaccggcgatctgcttggggctgaacgccggctgggcgaggcggcgcagccgggtgtggtccggcggatccttgtccaggaaggacatgtcgatctggtcgcccggggcacccggcccgttcatctcgaccgcgcgcgggccgaatctgcggtcgcgcagcacgctgttgcagaccgcgtgggtggcggtggtgtagttgccgagccgggtcggcatcagcgggccgtgggcgcggacctcgtcgtatacggcgtacgggtcgttgcgcccctcggccaggtgcaggcgggacagtggatcccgccgcacccggccccagtagttgatggctagttgacgctggtacaacgcggcggcgaagcgcagagcctgcatggtccgcacgttacgccacgaatcgccgccggtgcggtaagtgatctaggacagttccgcgacgtaacccgagacgcgggccagcgcggcgttccagttgatcgcctcctcattggtggaccaggactggatgtcgtcgatgtagcagaactgggcgacgcagcccgtcagcttctcctgcgccagcggatcctggatcgaggagttggcgccgccggccagcgtgccgttcggtgggtgcggcaggctcgggtccagctcgtgggcgtaccaccggctgtgctcgttctgcgacgagacctcgccgtagccggtcacgtacgactggttcagcgcgttgcggccgaacacgtagtccaggccggtcagcacgccgtcgcggtacttctgcttaccggtcagttggtgggcggccgacatcaccacgaggttgttcaggatgatgctgttcgagccccagtcccagacgttgttcgccggcgcgtagcccacgccgtacggctgggccttctgaacggccagatacctgtccgcggcctgggccaccgacttcctgatcctgcccaggcccggcaggttgttctggatcagcgccaggtcgagccggccggccgcggcggtggatccccagtcgaaggcgccggcgccgaacacgtccgcggtgttctccggggacgcgagcacgtccgcgcggtactgcttctcctcggtggtcaggtacagctcggcggccgcccagtagaactcgtcggagaccttcgcgtcgtcgtaggtgccgccgccggtgccgtccgacggcgaggccagcgcgatcgggttggtcttggccgcggtgtacgccttgcgcgccgcggcgagggtcctggccgcgaacgccgggtcgtacttctcccagatccgtgacgcctgcgcggccaccgcggccaggttcagcgtcgcggcggtcgagaccgggtgcagctcccgcggctgcgggtcctggtcgggcagcagcggcagcccggtccacgcctggtcgtgcaccttgtggtgcaccatcccgttcggcgcctgcatcttcagcaggaactcgagctcccagcggacctcgtcgaggatgtccggcgtgcggtcgccgctctccgggatggagagattcacggtgcgtacgtcatgggactgctcgtactcgctcagcagttcccagaccgtgatgccgccgttcaccacatacttgccgtggtcgccggcgtcgtaccagccgccggtcacgtccagccggtagtcgcagaccccggcctggcacggcacgttgccgtcaccctggttcggggccacgcccaggtgcccggccggccgcgcgtacccgggccgcagatcgtcgcggatctcgatgccggaccgctgggtgtagtagaacttcagcgcgtcggcgcgcagcgaccggaaggcggtcctgccgatgtcgaacgggcgggacgtctccccgtccgcggtgatggtgaagccggtcccggcggcgctccaccggctgaagtcgatggtctgcacattctggccggacgacgggtcgacgccgcgcggggtggtgtcaccctcgtacaccaccttgcccttcttgttcttgagttgccagggcagcggcgtggtcgcggcggtgaccaccgtggccgccttcgggccgtccggcagataggcgacctggttgacccggacccgcgggccggtgtccggcttgtacaccaccggcgggacgccgccgaccagcgagacgttgtcgacgcagaagtgccacggggtggcgctgccgccgacctggaaggcgacctggccctgcgcggtgctcgccgcggccttgaaggtgtactcgtagtgctgcaggtcgccgaggacgggcgactgctcgacataggtgtcgtacgggctgaccgcgaggccggtgatcgcccggaccacgtgcccggcgtcgcccgaggcgtcgaagctgaaccggtacgtctcgccggcgaccaggtcgatgtcgttctgcccgatcgcggcgtcccagcggttggtggtcccgccgggcacgtccacgcaggcccggccgtcggtgaggctgatcggcatgcccgcggtggaccagaaggggtcggatgttccgtcgaatccgccgttgacgacctgctcgacctcgtccgcccgggccggggcggaagcccccacgagcaggagggcggcggccgcggcgatcacgggggagcgctcccatagatgcatggagacatactgatgaccaatgtgtgaccacgtcaacgcccctggtcacgaatccaggcgtcgatcaggccgccgaagtggccgagaaacttctcgtgctcgtgcaccgggtacatcgcccggacggtttcgcgcagcagcgaacggaactcctccgaggtcacccagtcgtagacgatgtcgtcgaccgcgcccagatgcgtgtcgcagaactcgcggtaccggtcgatctcgaaataccggtccgccagatcccgataacccgacagcttctccgggtacgaccggtccgggtcgtcggcgatcgcgaagtagtcggcggtgtccgtgtccagccgcatccgccggccggtgaccacacagaagacactccatcgcagcagcgccgtcatcgcccacggaaagtagtagtgcagcgaggtcagcgccacgtccgggcaggcgttcgcatagtcgatcgggaacacctcgtcgccgcggaccagcgactcgcacgagttgaactcccaccggaagaacgcgttcaccaaccgggagacggtcaccacctcgtctcccgccgcatccgacaggaagtggtggtcgacctggtagcgggcgtgcatcggctggtccggcaggaaccgcatcaccatcgtctccggaccgatggtcagcgagcgggcgaacacgtcgtaatcctccaccgaggcctgcaggtgcatcaggcgctcaccggacgcgtcgtacgcggcatgcagctcctgcgcattgcggatcttggagaccccgacccaggcgcccccgtcgtacggcttcatgtacagcggatagccgatcgaggcggccgtcgcctccagatcgaacgggttgttgtaccgcgccgcggtgtacgcccagcgggagttgtccagtggattcttgaacggcaccagcaccgtctccggcaccttcagcccgagccgcatcatcgcgcagtacgccgcgtgcttctccatcgactggaaggtgaacgggctgttcaacaggtacaccccgtccatcagggcgatcttcttcagccactcccgggggtggtagtaccagtacgccagccggtcgatgaccaggtcgtgcttcggctgatcccgcagattgaacggctcgatggtgacccgcaccgcccgggtccggtgcgaacgcccgtccgggccggcgaccgtgccgagccggcgcaacagcgactcgaaagcgcgcggccagtcgtcctcggtgcccagcagcatgccgatggtgtgctcgacgtcggccacgtcgcctccgatcactcaggccaggcttggttcagcagggcggtcagatgtgggtccagcgcggtgcgccacgtcgcccagtcatgcccgcccgggacgacggcgagagtcgtggcatacccctgtttgtccagcgcatccgccatgtcccggttgttcgccaggttttcctcggcggaaccgcaggtcagggtcactggcacggccgggccgcgggtggcggtcagcacccggcgcacataccgcacgatccgcgaccagtgcgcgaaacccgactcctggcggtcgtggcggggctggaagaaactccccgactgcaggaacagcccggcgaagccggccgggaacgaccgctgggcgtgcaacatggccagcgcgcccaggctggcgccggcgccgacgacgggtcgcgcgcccagccgcgcccgcagccgcgggacgatctccagggccagggctctcgcgtacgcgggtgacgccgcataccagtcctcccggagctcaccgggcggcagcagcgccacatgacacccgggcaggcgcgccgtcagaccggtctgcgactcgtactccggaccgtcgtgggcgatcagcagccggtcgccatccccggccggggaccagacccgcgcggtcatcgacgtgtgcagggcgggcagcggcaggcggatcgttcgccagcggccaccacccatgaacgtacgttaacgccgcgccatgattttcgccttcgatgtgcccggttcgccgagttcggtgatccgcgccgtgacgtcctcgatcagcaccggatccccggtcgcggtcgccgcccgcaacaacaccgccagcgccgccatgctcgatgccggcgggcagcccggcagcagtgccggcaaccgggcggtcagcagctccaccgccacccgcggccggttccgccgctgatgcaggaaaccgccgcgcatggtcaccgcctccagagcgttctccggcgcgatcgcgtgatgcgcggccacctcggcggcatgccggctcagccggtccacccgatccaggtcaccgcgcagctcggcggcgtccgcccggttcagcaccgaccgcaggtagtcgtccaccgcgtccggcagcacactgcggaacagtcgctcggccgcggcgaaatgccgctccgcctcacccagatgcgcctcccggcggccgtgcccggcgcgggccagctcgacctcgacgacacccagattgtcgtacgtgatggcccgcccgaccggatcgccgaccagcggtcccacctgcagcgagcggaccaggtgccgtttcgcctcggccaggtccccgcgctcgtgcgcgaccagggccagattgtcgaggatcgcggcgtgcgtggccggatccggatccgagctggtgagcagcgccgccagggcgcgagagaagtgctcggtcgcctccgccgggcggccggcacggcgcagcacctcgccgcgctcgttctcggccgccgcactccggtagatctccgccactgatcaagtataaaaacgacaaagcggtgatcggccccatctcggcgagtgtcgccgtcctagggtggagggcatgcggatccggatcgaggggcgggagctgccgcagacaccggaactgcggctcaacaacgtgcacgtgggggtgcagcggcgggccgaggtggtcggccgggtgccggtgaccgcgggcagcgccgtctgggagatggacgtcgaggtgcgcgaggtcgacgggctgatcgacgtgggcgggccatgggtgcacgggtcgcccggggcgcggttcctctacctgagctggggggcggtgcacgacggggagttcgcgatgttccgccgggcgaagttgctcttcggggacgttcccggtgcgctgctgcggggagccgtggcgggggagggggtgctggtgggccggctcgggctgaccgattccgccggcgatccgctgtgcgcccgggtccggccgccggtcatcgcctggaccctttccccgttctcgtgagctgacctcacgcccacctgtgctgctaggcagccatgatcggttcggggcggccgaagtggtacccctgcaacaggtcgaagccgagcgcggtaagcgtgtccgcggtgtcggcatcctcgacgccctcggcgaccagggtcaggcccaggccgttcgccatccgggcgaccgactcgatgatcacccggtcctgcggctgatggatccgggtgacgaacgagcgatccagcttcaactcgctcaacggcagctgggtgagcaggcccagcgacgtgttcccggtcccgaaatcgtcgatcgccacccccacccccatcgcccgcagcgaccgcagacgatcagcgctctccgccggccgggtcatcaccgcgctctcggtcacctccacgatcaagccccgcggcggcaggccggtctcgtccagcagctcgccgatcttggtgagcacccggtccgaactcagcaccggcgccgccagattcaccgccaccggcacgtcccggcccgcccggtgccaggtcgcggcctggcgtacggcgtcacccagcaccgccgcggtcagcatgtgaatcacatccgagcgctccgcctgaggcaggaacacacccggcggcaacagcccccgccgcggatgcgaccagcggaccagcgcctcgaccgagacggtcgcccgggtctgcgcgtccaccaggggctgatagtgcagcaccagctcgccgttgccgatcgccgcccacagatcggtgtccagccccaggtcgatggcgccggcggcgagcgcgccgtgccacaactcgacctgggtgcggtcccgcttcgccgcgtacatcgcggaatcggctcgggagacgagatcctccagatcacggggatcgcccgggccgaccaccgcgatccccatcgacgcctccaccgtcaccgggacaccgcccaccgggaacggaccctggatcgcgtgcagcagccggtgaccggcctcgcacggcgacaggcccggccagaccgccagatccggggtgaacaccacgaactcgtcgccgcccagccggaacgcctccgccggccggcacgccccggacagcgccaccgccacctgccgcagcaactcgtcaccgcgggtgtgccccagcgtgtcgttgatctccttgaaccggttgaggtcgatcaccatggcggccgcccccggcgccggcgcccggcgcgacatcaggctgcgccggttgcccaggccggtcaggtcgtcggtcagcgccatcgcctgatagcgccggctgatgtgctccaccagcgggcccaccggggccaggccgaacgtgtcgtcaccgagcgccaccacgatcgggatcgccttcgaaccgtcggggcgctccatcgcggcgcgggccgcgtcaccccagtcggtggcggccggcagcaccaacgccgggcggcgcagcagcgaccgcaacggccggcggtgcagcagcgcccggccgtaaccgagccggccggccagcaccagatcgaggaaggcgcggtcgatcaggaacagctcgccgccggactcggtgagcacgccgagcagctccgggtcggcgcgcagagcggcctcgacatcgcccaccggggtgccggccggggtcaccggaacgggcacggcgagatcggcgaggacgggatcgcgcatgtgcccgcctccccccgaaacgccgccagcagtcgtccacgccgatgcggcaccggaccggcggatcacgattatgcccggccgtccttcgtggaggcagtccctgggtgaatcgttttcggaacctttgccgccggggcccggcgggtgtgacgatcctgttgcaggccggcgaagaatttgttaagcatcaatgcggcccggcggccatctgtcggtcgccgtcgatctccgtgcggatcgcggccatccctcgcgcattacggcccacccccgctgcccgctgcccgcccacccgcctgccgcccacccgcctgccgcccaccggcctgccgccgcctgcccgcctgtcgccggtcccgctgcccgccggccgttggcccgcccgggcctgcctgatgggcggccccgggtaggcggctgtcgcgttcggatggcgctgagctgggtggacggcaaagtgtcggaggggcggcctagagtcgtccgcgtgctgaagctcctcgacgacgagcccccggtccgggtcctgcacggattcgtgtcccgggacggcacgctgagcctgtgggccgagaccggtgtcccgatcccgatcccggcggccgcccgcggcgtcccgtggcatccgttcgcgctgccgcccgccgatctgccggccggcgagcggcgcgatccggccctgctcaccctgccgtccaccggagccggtccgctgccctcgccgcaggtcgggctcccgccccggcgcggcgcccggcgggcccgggtctggcgcgtccccgcggtcgaggtgccgttcctcgacgccgacctcgccgccgagttcgacggccgggtcgcgccttcggtccgctggctgatcgagctctgcgggttcgccgccggcctggtccgccgcggccgggtgctccccggcgtccggctcgacggtccccgccccgccgcctgctggcgaccgattctgatcggctccgacgcggcccgccacgccaccctgctcgaccggatgccacccgcctgccgcgccgaggccacccccggctcggagagccgcccggcccgccagggcgacaccgctcccacggccgcctccgccgccgacctctgcaccgcggctctggagcgcctcgtcgacgtcctcgtccgcacccgcctcgccgaggccggcgtcaccctgaccgagccggccatcccacccaccggcatcagcgccctagctagctagcgcgccggcgccgccccttccgtcaccgtgcccgacacgcaggctgcccattccgtcccccactctgcagcggcttcccgcgccggcggggctgcggccgatgacccgggtggcgccggcgttgccgccgactcgtcgcgcggcggcgcggctgcccggggcacgtcccgcggggcggcgctgccggtcgtgctgccggctccgatgctcgcgggtcggccgccggtggtccggtgcaggacgggctcgggggggtgctggcggcgctgagcggggagccgtggttcagcatgccgggggacgagctcgacgagttggtccgggcgctcgacgcgtggttcgcccaggcggcgcgtggggctgaggtgcgggtgtgcttccggctcagcgatccgcgggagcacgagccggtgctgcccggcgaggtgccgctgcccccggacgcgtggcggctggagttcctgctgcaggccgccgacgagccgagcgtgctggtgccggccgccgacatctggcgggacgatttcgccccgctgcgccggtggacgctgcacccgcaggagcggctgctggccgggctggggcgggcggcgcgactctacccggcgctgggcgacgcgctgcaccaggcgcatccggtggagatgatcgtggacaccgagggggcgcacggcttcctgagtcacgccgcgctgctcgacgaggcgggctacggggtgctgctgccgggctggtggcggcgccgatccgggctgggcctggcgctgcacgtgcgcagccccgagccgatcacgccggtgctgcgggaccgtacgaccggcctgcgggacctcgtcgactacgagtggggcctggcgctgggcggccgcaccctgaccgaggacgacctggccgacctggcgaaggcgaaggtgccgctggttcggctgcgcggccgctgggtcttcctcgatccggacaaactggctgccgggctggcgttcctgagccgcggcgggggcacgatgaccgcgggtgacgcgttgcgggtgacccgccttctgccgccggaggggctgccgctgccggtgaccgacgctcggggcgagggctggctgggcgacctgctcagtggcgaactggagcagcggctcgccctgatcgagcctccggcaggactcggcacggtgctcaggtcgtaccagatcaggggtttctcctggttggtcttcatggactccctgggtctgggcgcgtgtctggccgacgacatgggcctgggcaagacggtgcagctgctcaccctgctgctgcaccggcgcgacgggccggcgctgctggtctgcccgctgtcggtgctgggcaactggcagcgggaggccgcgcggttcgcgcccggcctgcgggtccgagtgctgcacggcgccgaccgggacgatccggccgccctggccgacggcgccgacctggtgctgaccacctatgccacagccgtccgggacgccgacgcgctcgccgcgatcacctgggaccgggtggtgctcgacgaggcgcagcacatcaagaacagtgccggtgcggcggccagggcggtgcggcgtttcccggcccgcaaccggatcgcgctgaccggcaccccggtggagaatcggctggccgagctctggtcgatcctcgacttcgtcaacccggggctgctggcgtccgcgcacacgttccgcgcccggttcgcggtgccgatcgagcggtacgaggacgaggaggcggccgcccggctgcggcaggcgacccggccgttcctgctgcgccgcaccaaggccgaccccggcatcgccggcgagctgccgtcgaaacggcacgtccggcacctgtgcgggatgaccaccgagcaggtcaccctctatcgcgcggtcctcgacgagctgctggagcgtctcgccgagccgggggagacccgccgcaagggcctggtgctggccgcgatgaccaagctgaaacaggtctgcgtgcacccggcgctgctgctcaaggacgcctctccgctgcccggccggtccggcaagatcgaacgcctggaggagatcgtcgaccgggccctggccggtggcgagagcgtgctgtgcttcacccagttcgcccggttcggtgggatgctggcgccacacctggccgcccggttcggggtgccggtgccgttcctgcacggcggcacgccgcgcggtgcccgggacgcgatggtcgccgagttccagcgggccgaacgccccggtgtcttcgtcctgtcgctgaaagccggcggcaccggcctcaacctgaccgccgccaaccatgtgatccacgtcgaccgctggtggaatccggccaccgagacgcaggcgtccgaccgggccttccggctcggccagcgcagggacgtgcacgtgcacaccctggtctgcctcggcaccctggaggagcggatcgaccagctcctcaccgacaagggtgtgctggcggagcgggtggtgggctccggtgagggctggctcaccgcgctgtcgaccagcgaactccgtgacctgttcgctctcgccccggaggccatcattgactgagtccagcaccatccagcccgccgagcgggacgggggccggcgatgagcgatttcgcgcccgcgttcctcgggatgttcgagtcgttgcggatggggccgaccttcgcccgcggccgccgcgacgagcgggccgggcacgtgcgcagtctgaccgtctccagcagcctggcggtcgcgctggtgcgcgggccggacgatccgtcggcgttccgatcccggatcgcggtccgggcgttcggcgcggccgagtgggcccgggtggagagtgccctggtcagccaggcccggttcgtcgccgggctgctcgacgggcggatgccgcccggggtggaggcggtgttcgccgacgccggcctgaccctgctgcccctctcgctggacgaggtggcgatggactgcacctgcgagcgctggccgatgccgtgcgtgcacctggccgccacctgttacgcgctcgcccggatgttcgaggccgacccgttcgaggtcttcgcctggcggggccggcaccgcgacgaactgttgatgcggctgcgccggctgcgggaggcggccgcggtaaacgcctccgacgtcgccgatgctgcgaaaaccgccacccaggcggaaaatcccgtcgagccggagccgccgctgatcgacccggatgatctggagaccttttggggccgcagcctagatcttggcgaatctcctgttcaggagccatccggcggccgtcccgacgcgcttctcgatcagctggatccgccgcggatcgggtatcagggccggccgttgactgacattctgcggccggcgttccgcgctctcgctgacaccgagggggtcggccgatcggcttagttcacggaaaacgccttaacgctccgggcagccatgatgcgctaggcgagtaatggcgttatgtccgaaaaaggtgtgacatgaacaaggcacagcgtttcttcgcgctcgccggcatgggtgtcgccgccggcgcgctgatcggcatgggcccggcgcaagccgcctcggccgccggcacgccggtctccgccggcggcgccgctaaacacgcgtccgactggggcgacgatcacgtgatcgggtattaccgcaccgaatggtcgtgcgaacgcgccggcttcaccggcaggcgctacggcgcctgggacgactacagctgcgatccgatcgactacggctggcggggctgggtcttccgcctcgtcgtcgaccaggacgactggcggtggagcgactggcgcggcgactggccgggtggctggccgtaccgccccgactaccggggtggctcgttccacatccgtgccatccacgatcactcgggcccgcacggctggccggaccggaacgaccaccgtggctggccggaccggaacgaccaccgtggctggccggaccgcggcggcaacgacgaccgcaacggcgaccgcggctggcccgaccggggcggtaacgacaaccgtggcggtaacgacaaccgtggcggtaacgacaaccgcggcggtaacgacaaccgcggcggtaacgacaaccgcggcggtaacgacaaccgcggtggcaacgacaaccgcggtggcaacgacaaccgcggcggtaacgacgaccgcggtggcaacgacaaccacggcggcaacgacaaccagcaccactggcccaggccgtgaacctggccggccgcgccccctccataagggggcgcggccggcgccgtcaccacgccaccggcgcgtaatccttcaggaagcacccgtagacgtcttccccctgctccccccgcacgatcgggtcgtagacccgggccgccccgtccaccagatccagcggcgcgtgaaacccttcctcatgcagccgcatcttcgtcggatgcggccgctcatcggtgatccacccggtgtccacgctggtcatcaggatcccgtcggcgaacatgtccaccgcgctggtccgggtcagcatgttcagcgccgccttcgccatgttcgtgtgcggatgcccggcgcccttgtagccacgcgcgaagatgccctccatcgcggacacgttgacgacgtaccgccgggggaaagacgatgcggtcatcgccggccgcaagcggctgaccaggatgaacggcgccgtcacgttgcacagctgcacttcgaggagttccagcgggtccacctcgtgcacccggtcgctccagctgttggtcgccgtggtgtccggcaccagcccgcccgcgtcgatcgccaccgaccgcgcggtcagcgccagctcggtgatctgctgcggggtcagatgctgggcgccggcggtcagcacggccgccggggaactaccggcactcccgaaatactccagttcgggaagtctcccgccgggcagcgcttccgcctcggcggcggcgatcgccgcgtacgccccggcggtccgccggaccgtctgcgccgcgttgttgatcaggatgtcgagcggcccgcgggcggcgacggactcggccaggcccaccacctgcgccgggtcccgcaggtcgataccgaccacccgcagccggtgcagccagtcggcgctgtccggcatcgcggtgaaccgccgcaccgcgtcgtgcgggaaccgcgtggtgatcgtcaggtcggccccgtcgcgcagcagccgcagcgcgatgtacatcccgatcttggcccggccaccggtgagcagcgctcgccgcccggtaaggtcggtccgggcatctcgccgctcatggttcagtttggcgcagtccgggcagagctggtggtagaacgcatccaccatcgtgtaccgctgcttgcacacataacacccgcgcgcctgcttgagcaccccggcggtcgctcccaccgtctggctcttcagcggaatcccggcggtctcgtcatcgatccgcccgggcgccccggtcgcggtcgccgccgtcaccgcccgatcgttgtcgagcacggcctgccgccggtccttgcgccgctgcaacttcaccgtcttgaacagcgccgccgtagcccgccgcacccgcaccgcgtccggatgctccggcggcagcccctccacctcggccagcacgccgaggcagaccgccaggcggtccggatccacgcccacggtcgggtcactgccggtcatccgtaaaatctccctcgtcgccctgcctgtcgcaggcactgtattacccggcgctcctatcggccgccacccgcttcccggaaggggtcccggtcaccacacctctcgcggcccgctgaccctcccggttcgctgactgccgctgtacgaccggtggtcccggcccgccagcccctccggaccgttgcttctcccgatccgctgattgcggtcgtacggtcgtcggccggcccggtcgcgctgatcgccgggcggggccgcctcgtgatccggtccgtgcctcggtggggtggccggcgggggctgtcggccggggtgggtgccccggggccgggaggttggatcggcggagagctgcccgcccgacggttgcgggcgggcacctcggtgaggtcgatcaggatgcggacgggtccggatcgttgtcgcggtccggcgccgccgggctctcgggggcgggttgctgcggtccgctgccgggtcggcgggggcggtcggggtagtggtcggcgagcgaagccgggcgccgggccggagcgggcggcttctggccggtcgccttcccggggcgcgggccggccgagccgatcggtcggttctcgccagccgccaggtcctccaggctctgcggccggggcccggccgaactgaccggccggttctgcccggcggtcaggtcgcccaggctgcgcgggcgcggtccggcggagctgaccggccgaacctcgccggcggtcacatcgccaagactctgcggacgcggctgggccgggtccccatgcagccattcgtcgagcgtctgcggccgccgcatcggcacggagctgaccggcgccgcactcaccggggccacatcaccgaccgccgcgggccgcttctgcgactcgtccaccggcgacacgcggggcgtcacctcgaccggcgtggtagccggccgactcccatgcagccactcgtccaacgtctgcggtcgccgccgcccgaccccgggcgcgttgacggtcgcctcggccgccgatccggaacccgggccatcgctgtccgccccagccccggcagcagcctgacctcccgccccgaccccagcgtcggccggggtcaccgccgcggatccggcgtcgacctcggatcccaccgtagatccggggtccatctcggtttccaccgcaggtccggcgccggacgcgtccgcagatccggcatccccgtcaaacccggcaccaccgtcgacagcaccaccgtcgacagcaccaccgtcaacggcggcaccgacgtcaaccggggcacggacttcgatcctggactcggcgtcggcctcgggcttcggcgaggtcggcgactcagcgctgacgtcgtcctctaccgaggatcccgtctcgttgccgatttccgccgcgtcatcggtgtctgcttcgaccgaggggctggcgtcgttgctggcttcggccacgtcaccggtggccgtttcgtccgccgatccgggattggcgtcgacgtcgcctatgggcacggcgtccggcgtggcttcggccgggccgtctggggggtcggtgttgggttctgtccggccttcaggctcgctgcccgcttcgacagcggattcggtctggggctcggcggccttggcgacgtcctccgaaacgggattcgcgcggcggggagcgttgggaaggtcccccagggtcgctggacgggccggcttcgccaccgggaagtccagggcgccgggctgctccggggaagtcggcgttatcgggaattccctggtctcggtaagccagttgaagtccgaacccgtctcggtcgactcattcccgccgctgacgatgccggcgatcctgggatccgacatccaggtgaacgcgtccgcgacctccgccgggatggcggtgaccggtgccatctcggcgacgtccgccgccggggctgtcgtgtcggcgtcggtttccggcgcgatgatcggcgcgaccgcaggcacctccgcggcagaagtcgctgccgcagcggtgggctccggcccggtgaccactttcccggtgtctgacatcaggtccgagctgatgatcttgccggccggctccggcgtttcggatccctgttctcgcggttcaggcgccatcccctgcggtgcgggagcctggtgcgaggcctcggcggcgggcgtttccgcggaaccggaggcggccgtccgggcgtccgcggccagagtggcctcgacctgggcccacagcgacgagctgtcgagcgggtcagccggctccgccagcccggtcgactccgagaatgcggcgtccgaggatccaggcctcgacgacgctgggcccgagagatctgctcccgggaatgtggcgtccccggcccgggcgtccgaggatgcggcttccgacgacgtcgggttcgagagtgctgcgtccgtggatgcggagtccgcggatacgggatccgcggatacgggatccgcggatacggggtccggggctgggatgccttcggacggccctgacgggtgatcggctggttgggtggagtcggattcgggggcgaccggggtgggagtggtcgtggagcgggagcgcagcagatggggggagaggatcggcatcacctgggtgacgtcgaaggctccgcttccggccaattcccgggaagccgcgtcggcgggcctggatttcgtccaagcgctgaagcctgtggtcccggcccgactgtcggtcgaattcgaaggggagaacgaggtggaggtcgcatccggagctgaagcggccgccggagggggagtggatgctgcctcgtgcttcgcggtggccgtcaggccgcggctgtccggggcatccgagagggcatcgcgagccgacgggtcggcgagggcaccagtttcgaggtcggaaaccgccgaaccatcgaacgccgccgcaacatcggaaccggcgccggcctcggaaccggcgccggcgtcagaagcggcgccggcgtcacgagcggctccggcatcaaatgcaatgtcggcgttggaagcggcgtcggtgtcgggcacagcgtcgacgtgggaagcggcgccggtgtcggcgtggaaagcggcgccggtgtcggcgtgggaagcggtgtcggtgccggcgtcgtcggcgtcaacgaggtcacccgaatcggccatgccgccgctgtcggagatgtcgcccgagtcggtgaggtcgctggcaggagcggtttcgccggccgcgggatcccagaccaggatcgacgtttcgtccggtgcgaccaccaacgattcgtcgccgtcagcggtcaggccgctcgcctcggtgtcagtgacggcaacggagcccgtcgcgtcgtcgcgggccgcgggcagcgtcgctgtctcgccgtcggtgacagctgggaagaccgctgtatcggcggtgcggttggcggccgggccggttgactctgcgtcggcggcgccggggtcggttccgtcgccgggcgcggcgtgggggtcggtctcggcgtcgtggatcgcgggcggcgtcgttgtctcgtcggcttcggggtctgcgtcggcgtcgatgtcggcttcggggcccgcgtcggcttcgttgtcgccgcggacggcgggcagaaccgctgtgtcgtcgctgatggtgggaagggtggttgtttcgtcgttgtcccggacgcgggggatgacggcggtctccgcgtcgcgtcccgcgcccaggtgtgccgccaccgccgtgtagtccaacacttcggttcggggttccgccacggccggcagcgggtcgtgctccgccaggcccgccctctcctgcaggcggcgcaggggtcccggtgcccaccaggcggcgttgccgagcagggcgaggacggccgggacgaggagcatgcgcacgacggtggcgtccaggatcagagcggtgatcatgccgacgccgacgaagcgcatggtggtgatgctggagagggcgaaggcgccggtgaccacgatcagcagcagggcggcggcggtgatgacgcggccggtgcggctgaggccgatggtgacggcttcggcggtgctggcgcccctggtgcgggcctcgaccatccgggagagcaggaacacctcgtagtcggtggacaggccgaagacgacggcggccatcagcacgacgatgccggcttccagcggggccggggtgacgccgagcaggccggcgccgtggccctgctggaagagccagacgagcaggccgaaggtggcggacaggctgaggccgctcatcacgacggctttgatcggcagcaggacggagccgaaggccaggaacatcagcagcagggtggcgccggtgagcaggccgatcatcagggggaggcggttgccgatggcggcgaggctgtcgacgttgcgggcggtcacgccaccgaccaggacggtggtgccgggcgggggttgcagggcgcggatgtcgtcgacgacccggcgggcgggggcgctgaacgagtcggtgctctgcagggcggcgttgtagacggtgaggtctttgccggcgccggccggaccgaccgaggcgacgccggggatcttcgccagctgcgcggcgaagggcttggccgcggctgccggcccgcgcacgacgacctgcaccccgtcgccgctgaactgggggtacgacgttttcagcgtctcgatcgccacccgggccgggtcgccggccggaaggacccgttcgtcgttctccccgaagcggacgcctccgatcggcagcgcgagcacgatcagcccggccaggatggggatggcgacgagcaccggccggcgtagcacgaagcgggcgagccgcccccagccgtcgccggtgcgctgtgcgccgggcagccggaccgggagtttgtcgacgcgcgggccgaggatggcgaggatcgccgggagcagggtgagggacagcagcatcgccaggaacaccgcggccagcccgccgtaggcgagggatttcaggaagccctgcgggaacagcaacagcccggccagggcggtcatcagcagggtggcggagaacaccacggtgcgtccggcggtgccgacggtgcggcggaccgcttcggccgggtcgtggccggcggcctgttcctcccggaaccggccgaccatgaacagcccgtagtcgatcgccatgccgaggccgaggaggctggccacgttgaccgcgaacgagttgacgtcgtggccgtgggagatcgcgttgagcacgcccagcgagccgaggaccgcgcagccgccgacgatcaccggcagggtcgcggcgaccagcgagccgaagatgaacagcagcaggatcagcacgatcggcatcgagatcagttcggctttgccgaggtcgtcggtggaccgctggttggaggtgtgggcgagcgggacggcgccggcgagtcgcacggtggcgccgctgaccgcgaagtcgtcggcgatccccgcgaacgcctcggtcttggcggcgtcgtcggcgccggccaggctgatcaccgcgaccgcgctggaccggtccttcgcggcgtaggccgcgctcttgcggtcccagtacgacgaggtcgcggtgaccgtgttgctgggcagcccggcaagtcgttcccggatccgcccggtcagcccggcgtcgtcgatgccgatgccccgggccggggtgtagatggcgatgacgtcgccgcccggcccgccggcctcgtcggcgaccacctcggcggcgcgcgccgactcgctggccgggtcggcgtagcccccctcggtgagctgcccgaaaacgcccatcccccagatgccggcaccgagcaccgccaccagggtggcgagcagtaccggccaacggaggcgggcgacccgcgatccccagcccgcgaacaccctgttcccctttcccggtggcgggcgcaccacgcaccggttcgtacggaaatatcgtgacttctgctagtgcagtgtggcggcctcgagcgcgaccccgccgcagtccgggtcgaacgtcttcccggtgatccactcgacggagatcttgccaggcccggtggagcggtagttgatcgtgtatcgggtggtggccagcgtcgcggccttgcgggtcagcgcggaggtgtaggtctcgccgccggtggtgagcttgagtctgagcgtgccggtcgccccggccacgcccaggtagaggcgcagggtgcgctgatccggggtggccggcgcggagagggtgaacccgttgccggtgccgcaggtgcgcacgccgctggtggcgccggcgttcttcggcgccggggtgccgccgctccagacgtagcgttgcgggctcagcgtgtgccgccggcgcggcgcgtccggggtgccctccaggatcgcgaatccgccggaggagctgcgttccagcgagtacgtgccgtcctcgccccagtgcacccagtcgatcgtgccctcggcgctcaggtcgacggtgtccgggatcgatccctcctcgacgctgatcgcgttgaccggcggtgcgctctcggtgatcgacgggctgggcagcgggatcggcacctgttccacggtcggctcgacgaccgcgccggtcaccggatcggccgccggatggtcaccgtggctcagtttcgccaccacgccgaccgcgaccacgaggagcaccccgatcaggatcaccacggccgggccgaggtgatcccgccagcgcgggctgcccggcttgagcagcacatccggcacctggaggcgacgacggcgcaacagttctccaaaaaacggcgggcggcggcgggtgaaacgatctcatcttcccggcgcggggtgaagggcgggcccgggtacggcccgtacggttgatcatcgccatcggtggttcggcggaggttcttcgcggctttcctcacgatcccgagtaccgtgtccgaagtctccgtttttgctcgccaccgctgatcaccgaggagcttccaggatgagtgaccggaccaccccgtcggacaagcgccgcggccaggcgatcgcgggcggcgtcgcgggcgcgctcgtcttcgtggtgctcgtggtggtgttcttcgtggtgcggggcggccacgacaagcagccggccgcgaccagcgccgccgtgcagcaggacagtgccgcagcggtcgcgcccccaccggcggaggcgtccccggccgccggccttcccccggagctgtcccacgagcccgacgtgcagccgggcaccggcggcccgctcaccgagctggtcgccctcccgctgatcgtcggcacgggcccggtggtcgccgccggccagacgatcaccgtcaactacaagctgatcccctacaagggcggcgcggtgatggactcgtcctggagccggcacgagcccttcaccacggtgatcggcgccggccaggtcatcaagggctgggaccagggcatccccggccagcacgtcggcagccgcatccagctggacgtccccgccgcgctcgcctacaaggaccaggacctccgcttcgtggtggacatcctcgccgcgcactaggggcccggggtctagagctcggcgacgacgatgtcgagctggcggggccggccgggcggcgccgggcgttcctcgacggtgaacttcaggtcgcgcatcgccgtgatcagctcgtccaggctggacggggcgaccggctcggtggccagggcgcgcaccagccggcccttggtcgccttgttgaagtggctgaccaccgaccgcttcgccaccccgccgaccacccgctcgtgcagtacccgcagggccgccacccggctcgcggtcgccgcgggcggcgaccacatcgccgcgtacgcaccggatcgcagatcgaggaccggtccgccggcggccaccgggtcgagggccctgctcaactgcttcttccagtacgcggtcagcccgccgaccggggcgggcagactgaccccgaccgagcagcggtacgccgggatgcggtcgccgagccggaccaccccccacagcccggagaagaccacggccgtctcgtacagccttgcccgggcggcgtcgtcgagcgtggcgggggcgagggcctcgtacagcacgccggtgtagatctcggcggcgggaccggccggcgcctccggcagggccgcgttgcgggcgatctcgctcctctgcccctcgctgagcccgagaacggtcagcgagtcggcgatcgagcgggcgctgccgcgtcggcacatcgccaccagtctggtcatcacccggcggcgggccgcgccgagcgcgggcagccacagggtgtccgggtcgaccggggaaccggtggtggcgggagtcttgccctcggacggcggcagcagaatgagcacccggcgagagtaaccgtcagccggatgtcaaaaaagtttgacttcggcggggcgcccggcctaccgtggcgatgtcaaagatttttgactccggggaggcgtcatggacatggccgacgacgagccgctctacaccacccgggaggagcggcaggtctggtcccaactcgcctgcatggtcgtgtccgcggcggcctacaccgcctgggtcctgcccgaggtggcccgccacccggtcgccgggatccactgggtggtcccgctgttctgggccaccctggccggcctggtctgcaccgtggtggtcgccgtcgtgctggagatcgtggtggtcgtccgtcgcggcgcggaggcgaagagcgcggtcaccgtcgacgtccgggaccgggagatcggccgccgcggcgtgcggctggccaccccggtgatgggcaccgggctcgcggccgtcctggtcctggccgcccgcggcgccgacgacttctggatcggcaacgtggcgttcctgaccggcctggtggccgcggtcgccgagagcattctcaagatccgcctctaccggcgcgggttctgaccgccgatggcgccgaaagccacccgggtcaccaaccggatccgtgccctgcgcgccgcggcgggcgggatgacgcaggccggcctggccgagcggctgggggtcacccggcagacggtgatcgccatcgagcaggggcgctactcgccgtcgctggagctggccttccagatcgcccgcatcttcgagcagccgctggacaccgtcttccagtacgacgaggggtgagcgctcagcccagcaccgcggtgaccatgcggtgcacggcggcctcgtcgggggcggtgccggtacggtcggcgaagagcaggtggccggtcccgatcagcatcgccgcgaggctgtccacctcggtgccggccggcagccggcccaggtcgcgttcggcggccaggtaggcggcgatcatctcggccgcctcggtgagcaccggcacgccggccggccaggctcggcgcaaccgggcgcgcagcccgtcgcggaaggtgatcagcgcgacgacggcgaccgcgaccgactcgaacaccccgatcagtgcggtggtcaggttcccggcgaccgtgccggtgccggccgcggcgcgcagcgtgaccgcctccggcgcgagtcgctcgacccggtcgagcacgtagtcggccaggaacgcgtcgaagtcctcgaagtgccggtgcagcacgcccttggcgcagcccgcctcggtggtcaccgcgcggctggtcagggcactgggcccggcgcggagcaggatccggtcggcggccgcgaacagctggcggcggacgtcacggagggctacccctgtcggcaccgatgatcctctcccgctgagcctggcccctcaacctacccggtcctatagtgggcacatgcccactcaggatctgcgccaggccgccgagtcgttcggcatcgacgccgcacgatacgaccggacccgcccgccctacccggccgagctgctggaccgcatcctggcggccacgcccggccgcgcggtgctcaatgccggctgtggcaccgggatcgaggcccgccagctgcgcgagcgcggctgcaccgtgctgggcgtcgagcccgaccggcggatggccgatgtcgcccgggccagcggcattccggtcgaggtcgcccggctggaggagtggcagcccgccggccgcagtttcgacctggtggtggccgggaccgcgtggcactggatcgacccggtggccggcgccgccaaggccgctcaggtgctgcggccgggtggccggctggccccgttctggcacacgttccggctgccggacgagctgaccgccgcgtccgccgaggtgttcgcccggctggcgccggactcgccgatccggctgccccggcaggcgcccgccacgccggtggagggttaccggccgatcctcaccgcggccgccgacggcatccgggcggccggcggcttcaccgagccggagcagtggcaggtggactgggagaaggcctacacccgggacgagtggctcgaccagctgcccacctcgggcgccttcacccggctgccgggcgatcagctggccgcggtctgcgacgcggtcggcgcggcgatcgaccggctgggcggcggtttcgtgatggcctacacctcggtggcggtcaccgcggtcaggacttcgccggcacggtgaccgtggtcttcacggtggcccggttcaggtcgtcgacccggatggtgaaggcgatctcgtacgtgccgggcagcgggaacgacaccgaccccagcgcgtggtgcggcggctccagcccgagcagcggctccttcaccgcttccaggccctgacccatcaactgtgtgctgatctgccactcggccggcggcagcggcttgccctccggggtgtacaggaacgcgtgcacggtgttgtactcgcccaactccaccggatagatgttgaactgcagtgtgtacagcgggcaggtcagcgtctgcgacaccccgacaccggtcaccgcacccgcctcggccccggccgtacgccccgggttgacctgcaccagcaccgcgctcaacgccaggatcaccgcggtcgcggcgacctcgatcccgaccgtgcggcgcagcccgcgcccctcgggggagcggcccaccagccggcgggcgaccgcggccgccgccaggaccagcaccagcacgcccagcttgaccagcagcacctgcccgtacccggtgtgcagcagcgcgtccaccgcgccgacctgcaccaccgcctggaccgcaccggcgatcgccagccacagcacggacagcatcgcccagcgggaccagaccggcagcagcacgcccaggatccggcggtcggtgccgcgcagcaggaaggcgagcagggtgaccagcccgccgatccagatcgccatggcggccaggtgcaccacgccgacggtgaccgtgacgaccggcagcggggcggcgaccgcgtgcccggtcagcggccaggtggccagcccggccgcgccgagcagcagggttgccgccacccgcgggcggccggccgggccggcccgcagcaggggctgcaccagcggatacagggcggccagcagggccaggcgggcgatcagggtgaggccgaaccggctgccggcgacctcggccagctcgccggcggacacctgccacagggcggcgccgctgccctgctgggcctgggtgccgagggccccgagggtggcgagggcgatcagggcgaagccggcgcggaccgtgcggatcggcccggtgcgcgaccggcggcggggccacagcagggcgagcaggagcgccgggccgatggtgagcgtgatgcccgcgtaccccagcaatcggaacgcgggcacagcgaaccgcacgctgggatggatgccggtgctggccgcggcctgcggacgcgccgaaggcgcaccgaccgagaaggtgatcgcgccaccgaccggatggctgtccgcggagatcacccggtagctgatcaggtacgtcccgagcgggtgccgagccgcgcggaccgggatgtgcagcaccgcgccgcgcgccgtggccagcccggagatccgctcgccgtccggcgccaccacctggatgtgcccgctgaccggggtgatcgtctcgctgaaggtgaccgtcacctcggccggggaggcggccaccacgctgcccggcgccgggctcgaccccaccgtcgcggcgtgcgcggaagccgcccgcggcgtcgcgagcagcgctcccaccagaacgaggagcagcacgagcacgcgcggaggtttcccggtcacgcaggatagttcggatcgtggtgcggaaaggttcaagacggccgcggctggataccatctccagggattccaaggaggccaagatgtccgtccacgcccgcgccggccgccccgcggaagcgtccgatctgatcgacgttccgaaggtcgtctcccggtactacaccgagcatccggacccggccgaggtggtgcagcgcgtcgcgttcgggacctccgggcaccgcgggtcgagcctgcggaccgcgttcaacgaggaccacatcgccgcgaccagccaggcgatcgtcgagtaccggcgggcgcagggggtcgacggcccgctgttcatgggccgcgacacgcacgcgctgagcgagccggcgcagatcaccgcactgtcggtgttcgccgcgaacgacgtgacggtcctgatcgacagccgggacggttacacgccgacgccggcggtcagccacgcgatcctgacctacaacaggaagaatcgggccaaggccgacggcgtcgtggtgaccccgtcgcacaacccgccggacgacggcgggttcaagtacaacccgccgaacggcggcccggccgacaccgacgccaccaggtggatccaggatcgggcgaacgagctgatcgccgacggcctcaaggacgtccgccgggcgcacggcaggggcgacacctacgacttcctcggctcgtacgtcgacgacctgcccgcggtgatcgacatcgacgcgatccggaacgccggcgtccggatcggcgccgacccgctcggcggcgcgagcgtcgcgtactggggcgagatcgccgaccggcaccgcctcgacctgaccgtggtcaaccccacggtcgatccgcgcttcgccttcatgaccctggactgggacggcaagatccggatggactgctcgtcgccgtacgcgatggcctcgctgatcgagcagaaggaccgcttccagatcgccaccggcaacgacgccgacgccgaccggcacggcatcgtcaccccggacggcgggctgatgaacccgaaccactacctcgcagtcgcgatcgactacctgttccgctcccgcgacggatggccgggcggcgccgggatcggcaagacgctggtctcctcctcgatgatcgaccgggtcgcggccgacctgggccgcaccctggtcgaggtgccggtcggcttcaagtggttcgtgcccggcctgctcgacggctcgatcggcttcggcggcgaggagagcgccggcgcctcgttcctgcgccgtgacggcggggcgtggagcaccgacaaggacggcatcctgctcgacctgctcgcctcggagatcatcgcggtgacgcagaagacgcccagcgagcactaccgggcactgaccgcccggttcggggagccggcgtacgcccggatcgacgccccggccacccgggaggagaaggcggtcctgggcaagctctccccggagcaggtgaccgcgaaacagctcgccggggagccgatcaccgcggtgctgaccagcgcgcccggcaacgacgcggcgatcggcggcctcaaggtggtcaccggctccggctggttcgccgcccgtccgtccggcaccgaggacgtctacaagatctacgccgagtcgttccacggcccggagcacctggcccggatccaggaggaggcgcgcgcggtggtgtccgccgcactccggggctgacgaaccactcagatccggccaccggcggccgactggtaagccatcatgagtacccggggaacggcagctgaacagcgacgacgcggcgggctggcgcccgccgcggtggctctgacggcatccgtcgcggtggtgctctggctggcgctcggcgccggcaacctgtacgccggattcaccggcggcccgatcgcgatggccgccgcggccttcgcctgccagcggatcgccgcgacggtgcgcctgccgccgccggtccggtcgttctggcggcagctgcagtacgcggccttctgccttctcgccgcctcggtcgtcacgctgttccggtcgaacaacgacaccggtctgtcgccgtacgtcggtctaccgatgctggtcggcatcctcatcctgatgaccgcgttcctgcgcctgccgttcggcacgcgcaccgcgaccggcctggtccgcgccctgctcgacggtgccaccgtggccgtggccagcggactgatcttctggtacgtggtcctcgacctcgccccggccggcacctccctggtcgcccggatcgtcgcggcggtgatcggcgtctgcggcgtcctgctgctcgtggtgatcggcaaggccgccgccgcgccgtccagcccggtcgacccggcgtcgctgcgggtcctcaccgtcgccccggtggtcgcggtcaccggaaccatcctgctgatcgccggctccgaccggggccggctgatcctgtcggtgctggccgtcccgtcggtcgcggtcgccatggcggtcgccgcgtatctgcagcgccgggcgcggcggacgacgaccgcgaccgccggccgctccctgctcagcctgctgccgttcctcgcggtgaccgccaccgccgcgctggtgatcagcgtcagtgcccagcagatgtccagccggcagcgcaccgtgatcatcggcgccgtgctgatcgccggtttcgtggtcgcccgccagctgctcagcctgcgggagaacaccatcgcgatgcgcggcatccgccgccagcaggccgaactggaacgcctggcgctcagcgacacgctgaccggcctgccgaaccgcacccggttcgcggtggcgctcggcgacctgatcggcgagcaccgaccggccagcgccctgctgatcgacgtcgacgacttcaagatgatcaacgacacgctcggcccggccgccggcgaccagctgctcttccaggtcgccgaacggctgcgccggcactgcctgcccggcgagctgccggcccggctcgggggcgacgagttcgccgtgctgctaccggtcgacgacccggccgaggcggaggccgccgcggcccgcctgctggccggcatcaccgaacccttcaaggtcggcgaccagcagctgctgctgcacgccagcgtcggcatcgcgatcgcggcgaccggcgagaccgccgacgaggtgcagcgcaacgcggacatcgcgatgtacgccgccaaggaggccggcaaggcgtcctgggtccgcttcgagccgcggatgcgccacgacatggtgcaccacgcccggctcgccagcgaactgcacaacggcatcatccgcggtgagctgcggctggtctaccagcccgtcttcgacctggtcaccggccgggtcgcgggcgccgaggcgctggtccgctggcagcacccgacccgcggcttcgtctccccggcggacttcatcccggtcgccgaacgctccggcctgatcgtcccgctcggcgcctgggtgctgcgcgaggcctgcgcccagctcgcccgctggcgcgcgcagtacggcgacgacgccatcgagtcgatcaacgtgaacgtcgcggtccggcagctgcgcgagaccggcttcgtggacgaggtggcggccgtgctcagcgaggccggcctgacctcgcgcaacctgatcctggaggtcaccgagtcgtcggtggtcgacggctggcaggtgcgcgagacgctgcaggcgctgcacgagatgggggtgatgctggccctcgacgacttcggcaccggccagtcgtcgctcagcctgctgcgcgccttcccggtcgacgtcctcaaactggacaagtcgttcgtcgacggcatcgcggacggtgccgaccggggtcgcctcgcggtggccgcggcggtggcccagctcgcggaatatctgcagctcaaggcggtggcggaggggatcgagagcgcggagcagcgggaccggctgcgggacatggggtaccgctacgggcagggttaccacatggccaaaccacttccggccgaggagtgcggcgccctgatgtccgcggcgcccgttccggccgccgtccggtccgcttgattgccggcgtacgcggacagcacccccgccgcgcacagtactccggccggggccgtcagccccgccgcgcaacgcaccccggccggggtcggtagccccgtcctagctagctaggggcggtcagccggtgacggtgagcgtggcgaggccggcgaccgcgagcaggtcgacgccggtgctgccggaccagtcggcggtggtgaacgagcggcccggcgcgatgccccggtgcgtcgcgccgccgagcgtgatctgcccggcgccggactggacgcggacccggaccggggtggcccgggagaggaccacccggaactggtcgacgccgccggacatccggaccggcagcaggccgtgcggggcgggcagcgtcaggtcgatccggctggcaccgccaccgaggtccagcgccgcgaggtcggccccggtcagatcgaggctggtctgcgcggtcccgccgtccaggcgcagcgtccagcggaccgccgagctgagctggacggtgaccgccgccgacccgccgctgccgtccgaccgcagccgcagccgcaccgtgccgtcggaccgttcgacggccggggtgagcccgctgcccgccgcggtgccgacccggaacaggtcggcgcccagatcggcggcgctcacccggaccagcgtggcgctgtccaggatctcgaaggacgccgcggccagcccgtcccgcggaccggccacctcgcgcggcccggtgccgccggtcgcctcggtcgccggcccggccgccatccccgtcggcgccgtcgcctcggagaccgtcgcgcgggtccccgaggcatcgtgccggaccagcaggaacgcgccgatcagcccggccagggcgacgaacgcgccgatcgccagcagcatcggccggcgctgccgcagcgcgctcggcagcggttccgggtcgggcggcgcgctccagccgggcagcggataggccgaggtgaacgcgggatcgtcgaacggatcggtggccggcggatagggcgccccggagaccgggatgaacccgtgcgggtcggtgtcgtcctcggcgaagtcgtccggccccggcagcggccactcaccggtcggctccggatccccggcggcgctggtggcggcatcctcggcggcaccggtggcggcatctgcggcggcaccggtggcggcatctgcggcggcgctggtggcggcatctgcggcggcaccggtggccggatcgtcggcggcgccgatgggtaggggagaggccagggaccggtcggtcagcagtgggacgcaatgatcgggttcggtcgggggatggtcagccggatccatgctcatcggtcctcctggcgccgtggtcctccaccgtgactacggaccggcggcctccgcagatcgaccggacggcaaacgcctcagtcccggtacaccgcggccggtggtgccgggggcgggccgagcggggtcagccagcgctgatagctgcgggtccaggagccgtccgcccgcatccgcgccagcaccgcgttgacgaagcggaccaggtcgggctcgtccttcgggatgccgatcccggacggctcgtccgagctgaaccgcccggtgacctcggtggtcgggtcctgcgcggccaggccggccagcagcacgtcgatcgtggacaccgcgtcgacctgcccctgctgcagcatcaccaggcagtccagggtgctgtcggtggccaccggaatcggcttcgacggctgctcggcgatggtccggatgctggtgctgccccgggtggcgcagaccttgcggccggccaggtcgctgaactcgcggatgcccgagccgcggcgcaccagcagacgctggtgcgaggtcagatactcggtggagaacgacacctgctgccagcgctcgcaggtcatcgacatggtgcggacgaccaggtcgaccttcttctgctgcagcaccgggatccggtcggccgtggtgatcgcctggaactgcaccgcgtcgtcccggccgaagatcgcccgccccaccgcccgggcgatgtcgatctcgaaaccggccaggtcgccggtcttcgggtcgcggaaactgaacaggtaggcgttctggtcgatcccgacgatcagccggccgcgggcggcgatcgcggccatcgggctcccggccggcatccggcccgccgtcgggagcgggccgtccgggcgcaggctggcccgtggcacgcagtccgggaccgggccggcgctcggcaccggggccgggtcctgcacgttctccggcagcggcacgacggcccgtgccccggccggatcgtcgggtgccggttcggcgccgcacccggccggcgcggcgaccagggtcagcacgaccagcggtgtcagcagccgcctcagccgtgccccgatccggggacgcaagctcgtcggtgcaccggtccgtggccgcaagctcgtcggtgcaccggtccgtggccgcgagctggtcggtgctccgatccgggggcgcaggctcatcggtactctccgatccgggggcggaagccgagcatgaccgcggcgaccaggcccgcggtgagcagcaggatcgcgatctgcaggccggtcagcgcccggccgccgtgcccggcctgccggtcgacccgctggttggcggtggccagggcccgggccaccgcggtgtccaggtcggtgacgacggcggtcaggccgtccgggccggccgccgtcgcctgccccaccgcgcccaggtagtcgccgctgtcgtcgagccggcgcagcccgtcgtgcagggtgtgccagcgggccgcgtgcgaccgggcggtcaggatcatcgcccggtcggcctccggtgcctgcgccgcggcagtggtgagcaggtcggtcagccggtcggcgaccgtgcggtagtcggtctcgaaggccgcgccgccgccgcgcgcgaccagggtcagcgactcgtcggcgcgcgcctgcaactccgcccggcgcgcgtcggcgagcacactgaccaggcgggagccgtcccggcggccggcctcgacccggttcgccgcgacccccagcgcggccgcggaccaggccagcgcgatcaccgcggccaggctggcggcgagcagcccgatgttgaacacccggttggtgcggcgggcgaccagcgtctgggcgccggtcaggccggccacggtgagcaggccgagcaccaggatctgccaggacgacccggccgcaccgcgctgcgcgtcggcgagccgggcctgcgccgcggcgaacagcccctgcgcctgcggcagcagcgtctcgcgcatcagcgccgacgcctcccgcaggtaggccccgcccagcgggatgcccatccggttgtccgcccgggcggtttcgaccagcccggcgtagaccggcagccgatcggtgagcaccgcgatccgggccgcgtcggcgtccccggcgtcgcgggccgcggtggtcagcgccgcgcccgcccgggacaggtcgtcgaggtagcgttgccgcagcgcggcgggttcggccccgccggtcaggaaggcggtcgccgcggtcgcgtcggcatcggacagcgcgcggtagagctcctgcgcgccgacgctcaacggcccgctcaccccggtgatgtcccgggtcagcgcggcacggtggtgcacggtggccagggcggtcccgccgagcgcgatgccgagcaggatcagcgccgcggcggtcagtcggtagaggtccggtgtggccagtcgtcgcaaaccgggcaaggtacgctcccgagggtcgccggtgactgccgctgacagtacggcgtcggggcaacgcgcatcgccatcaattccggccgagcaggtggtggcgcagatcccgggtgccgccggtggacgggcgggcggccaggatgcaggtgtcgtcgtccgggttcgcccggcgcagccggccgaccagttcggccagcggctgcagcggggcggcgcggaccgcgtcgtcgaccgtgtggatcaccgcgttcagtccggtgtccaggctctgcccgcggtgctcgaccagcccgtcggtgtagagcaggagcacgtcgcccgggcggaaatcgatcactgtcgaggcataccgggcgtcctccagcactccgagcatcgggccggccgggcgatgcagcgcctcggtgcgcccgccccggcacagcagcggcggcggatgcccggcctgcgcccaggtcagccggaaccggtgcggatcgaaccgggcgatcaccgcggtcgccgccagctccggggtctccgactccagctcgcaggtgagccggttcaggtggccgagcagggtggccgggtcgctgtcgaccacggtcagcgcgcgcagcgcgtgccgtaactgggccatgttgctggccgcctgggtgccgtgcccggccacgtcgccgaccgccagcagcaccgagccgtcgcgcagggcggccgcgtggaaccagtcgccgccgaccatggtctcctgcccggccggcagatagcgcaccgcagccttgagaccgggcagctcgatcggctcgtccgggatcggcaggatgatctcctgcagacgcagggccaggtcgtgctcggcgtccgcggcccggcgctgctcgtccagcttgcgttccacctcggccagccgctgtgcgctgaccggctgctcggtgacgtcctgcacgatgccgaacagtcggatcggacggccgtccgggtcgcggacggtgtcgacgaccgtacgcaggcgtctgatccggccgttgatcgtgactcgtttgaccagttcgacacggtcccggctctgcgtggcggccagcgccgcgtcgcgcagcgagaggccgtcggacaccccggccagccggccctcggcgcggctcagcgggccgagcgccggatcgcgctgatagatccggtacagctggggcgaccagtagacctcgccggtgaccaggtcccactcgccccagccgagcccggccagctcctcgaccccggccagccggtcggtgaccagatcggccccggtgaacggcgacagcggcgcgtccacgtggtcgagcagccggatcatccggccggccaccaccgccgggtcggcgccctgctcggcggcgatccgcagcaggtgccggtacgcgtcggcgatccggcaccgggcccgcccggcgagcaggccgaccgcccgctcgaccacggcgtccgcccggacccgccgctcgctcagcgcctgcgcgaccgcccgaccaaccacctgtacgacctccccgccccgcatccgggttccttgttacgcctgcgggcggggcccacacatcccccgatcattctccgccggccacagtcacccggtcaggcgtaagactttcggcggcgtcagagctcgaacaagtcccgcatcgcctcggtcagtcgggccatgctggcaccggtgaccatgccgatccgttcggcgccgaccgaggccggcaggcggcgcatccggttgatcaccaccacgccggtgatcgggtcctgctcggtgagggcgacggcgaacgggggcagctcggtcacaccgcgctgacgcacgatcggggcgcagtagggtgaggcgttgtcgcgttcgttgtagctgtccgcggagaggacgagcacccgatagcgcagatcggagcggtcgccgatggtccagatctcgccccggcgcacgtcagcaccggccggatgacggcttggtccggttcggcatggctggaagcgtaccgccgcgccgatcaccgccgcgtccaccccgcccggccccgaacgggttgagctgttcaccacgtggacgtgatcgaacttccacctgcccgatcccgtagaaaagagcgcggggcccgtgacgggccggttacgagaggacgtagggatgtcgcagaaggcgcagatcggagtcaccggccttgcggtgatgggccgcaacctggcccgcaacttcgcccggcacgggcacaccgtggcggtgcacaaccggtcctacagccgcaccaaggagctggtcgaggagttcggccaggagggcacgttcctccccgcggagaccgccgagcagttcgtgcagagcctggagcgcccccgccgggtggtcatcatggtcaaggccgggccggccaccgacgccgtgatcgacgagttcgccccgctgctcgaagagggcgacatgctgatcgacgcgggcaacgcgcactacgccgacacccgccgccgcgaggccgcgctcaaggcgcagggcctgcacttcgtcggcatgggcgtgtccggcggcgaggagggcgcgctgcacggcccgagcatcatgccgggtggtccgcgcgagtcctacgacgcgctcggcccgctgctggaggacatcgccgccaaggtcgacggcgagccgtgctgcacccacgtcggcccggacggcgccggccacttcgtcaagatggtgcacaacggcatcgagtacgccgacatgcagctcatcgccgaggcttacgacctgctccgccaggtcggcggcctcagcccgcaggagatcgccgaggtcttcgggcagtggaacgagggccgcctcgggtcgtacctgatcgagatcaccgccgaggtgctcaagcagaacgacgcggccaccggccggccgttcgtcgacatcgtgctcgaccaggccgagcagaagggcaccggccgctggaccgtgcaggccgccctcgacctgggcgtgccggtcagcggcatcgccgagtcggtgttcgcccgggcgctgtccggcggcgccgacgtccgcaaggccgccgccgacgccggtctgcccggcccggccgccggcgccgagcaccccggcggcgacctgcgcgccgacgtcgagcaggcgctgttcgcctccaagatcgtcgcctacgcccagggcttccagcagatccaggccgccagcaaggagtacgactgggcgatcgacccgggcgcgatggccaagatctggcgggccggctgcatcatccgggccaagttcctcgacttcatcaagcaggcgtacgacaagaacccggagctcgccaccctgctcgtcgacgactacttcctggacgcggtcagcggcgcgcaggacgcctggcgccgggtcgtcgccaccgccgcccagcagggcatcccggcccccggcttctcctcggcgctggcgtactacgacggcctgcgggccgagcgcctgccggccgcgctgatccagggccagcgcgacttcttcggcgcgcacacctaccgccgggtcgacaaggacggctcgttccacacgctgtgggcgaccgacgaccgtcccgaggtcgacgcctgatccacccgggcggccggcggctcacgtcgccggccggccgtcaggcgttctccttcatcaggtgaaccagggtcaggccgggtcggacctgctcccgatgggtttcctcgtaccgcgcgcgttcgtacagccggatgttcgtctcgctcagatggccggtgaacagcgcataccattcggcctgtccggccgccgcgcgctcgatcgcggtcagcagccgggtgcccaggccacggccgcgcaggtcgggggcgacggtcagccggccgatccgcagcaccgtgccgtccaggcggccgcggaccgcgccgacgatccggtggcccagggtggccttcagcgccaggccgtcggcgagctcggcggtcagctcgtccagggtctgggtcagggcgggcaggtgcgggtcgtcgtacagctgggcctcggtgacgtaggccgccagctgcagggtgaggatctcgccggcgtcggccggtcccgccgggccgatggggatctcgtccatatcgggccatgattctagaatccggccggtttgacaggatgttccgggtgaagccttcggtctcctgtgttttcgtgtgccacgacggtgccggccggatcctgctggcgcggcgttccgcccgggcccgcgacgagcccggcacatgggactgcggggccggcgcgctggagttcggcgagaccttcgaggaggcggtcacccgcgaggtgatcgaggagtatgtcgcgccgcccgagaccatcgagctgctcggggtgcgcaacgtgctgcgcgccgatccgccgtcgcactgggtggcggtgatcttcacagtcaagatcgatcccaggcgcgtacgcatcggggagccgcacaaattcgacgacctggcctgggcgcccctggacgccctgcccgagccgcgccattcccagctggccgccaccctcgccctgctgccccgtggatagcgctgccaccaccgccacacccccggcgctcctgcgcttcgggcagcgctgtcgtgaccgccgtgttccccgccgttgccgccttcggcgttcgacgacgcggatggggcagccgcgcgtcgcggggcctgccgcctccccgtcggcgtcgtcgctgcgatggccggggagtggcaacggtgactctggtcctgccgagccgatcgcgcgagagtgatagccgtggagctgaccctgctgtcccgggtggccgcccgcggcgtcccgatcagcggcgcccggctggccgacctgctcgccctgctcgccggtgacctcgccggcggctgcggcgccggccggctgatcggcgagctgtggcccgacgagcagcccgaacatccgtcgaaggcgttgcagaccctggtctcccgggcgcgcgcccggctcggcccggacgtcatccgcggcaccccgaccggctaccggctcaccctgacgccggagcaggtggacgcgtcggcggtactgctgcgggccgccgacgccgaacggcacgcccgggccggcgcacacgccgccgcggtggccgccgcggacgccggcctggcgctgttcggcggtccggaggcggacggtcccctcggtgccctgcgcgccgcccgcgcgacggtgcgggagacgctgctccgggctcgggcgctggcgcttggacggctcgggcagggctacgaggaactcgccaggatcgccgtggaccggccgcgcgacgaggagatactcgtcgacctgctgcgggtggaggccgcgacgcaggggccggccgcggcactgatccgctacgacacctaccgtcggcaactgcgcgacgaactcggcaccgagcccggcccggcgctacgggccgcgcaccgggagctgctgctcagcgacgccccggtggtccgccagggcctgcgcttcgagccgaacgagctgctcgggcgcgaggacgacatcgcggcggtcggagcactgctgcgtaccgcgagggtggtctcgatcgtcggggccggaggcctcggaaagacccgcctcgcgcaggcggtcggccgccgtgccggccaccggatgatcttcgtggtcgagctggccggcgtcacccgcgacgccgacgtactccccgaggtcgccaccgccctcggcgtcgccgaagcccccgacccggtcgccggcacggcccccaccctcgtcccggagcgggcctcgcgctccggtgcagcccccgccttcgtcccggagcaggccttgctgtccggcgtggccggcgcgctcacccccgggccggcgctgctcgtgctggacaactgcgagcaggtgctcgacggcgttgccggcctggtccaggcgctgatcgcgcgcagcggtgcggtgaccgtgctgaccaccagccgggccccgctcggaatctggtcagaatcggtctatccgctcgccgaactcgatctcgacaccaccgtcgagttgttcacccagcgtgcccgcgcggctcgcccggccgctgacctgccggccggcccggtccgcgagctgtgccgccggctggacgggttgcccctcgccgtcgagctggccgccgcccggatccgggtgatgtccccggccgagatcggccaccgtctggacgaccggttcgccctgctgcgcgacggcagccgggacgccccggaccggcaccgcaccctgcacgcggtgatcgactggagctggcacctgctcgacgacgagggccgcgcggcgatgcgcgccctgtcggtgttccccggcggcttcaccgcggaggccgcccggcaggtactcgccaggcccgtgtccggaaaggacgcggacaccgcccggcacgtgctcggcgaggacgcgggggctgtccggcacctgctcggcgctgacgcggtggcccggctcgtcgagcattcgctggtcaaggtgcaggacagtccggccgggacccggttcgtgatgctggagacggtccgcgagttcgccttcgcccaggccgggccggccgacgaggcggcattcctggcgtgggcccgcgacctgggcgtccgcgacgaaccggacctcgccgcggccctggtggtcggcgtcgacgggttccgcgccgaccatgacaacctggtgcgcgcccaccgcagcgcgctggccgccggggacgccgccacggtggcctcgaccacggcgctgctcggcacgctctgggtcaccgactccaacgtgaaccggctgatcgcgctggccgccgaggcgcccggcgcgctggtccggttccggcccgacccggcccaggtggagaccgtccggaccgccgcggtgtggtgcacggcgatcgccttcctggtgtccggctcgccgtcgttgcgcgccctggccgtgctccgccggctgccttcgcccgacccggccacgctggccggcgcggcccagacggtgatctgcgcccccgacctcgcagcgctggcgacgggcggaaccccggtagaagggagcagctgttcggtggtctcgggggcgggccgggacgcggggagcggcggttcggtggcggccggcgggagaccgccggccgcgggcgggagcccgctggtcgccgggctggccaactacgcgctcagctacgtcgccgagaacgccaacgatccggtcgccgcggtcgccgcggcccgcgcgatgttggtctgtctgcagggcgagcatccgtggctgcgggcggtggcccacgggcggatcggtgagctgtgcctgcgcaccgcgccgggggaggaggcgttccggcatctcgacgcggcactgtcgatcatggaggagctgggcgcctcggcgagtgcggcccgggctcgctgggcgatcgtcctggcggacctgcagcgtggtgctttcgaccgggccgagcagggactggaggtgctcagccggggcgttctcgacgaggaggccggccggatgctgttcgaacgctgcacccgcgccgagatcctgctcggccgcggtgacgtggacggcggcctggccctctggcgggaggcggcccgggcattgcgtcgtacccccgggctgtgggcgaacgagatggtcggggtcgcggtgctggtgcactgccggcacggccgcctcgacctggtccaggatctcgcgggggagttgcccgggcggctggcggcgctgctgcccgacgtgccggtggtgtcgttccgggtgtgcggggtgctgctgatggccctggccgaggtgcgtgccgcccggggggagccggacgacgggcaccgcgacctggccgagcgtttcggcttttcggggacgttccaggcaaccgtcgcggtcgccggcggcaccggccccgacctggaccacgaggcggtgcgcgccgccgcgctggccctgctgcgaatccctgcggagaagcgatagacgatgccaggccgctggcgggcgacggcgctgtcaccggcggcggcgccggcttatcgggggtcgcggcggaacagcagccgcgcccacaggtagccgcccgccgccagcaccaggcaccagagcaccgccgaccgccacgcatccccgaccgcactgcccagcagcagcccgcgcagcgtgtcgatgatcggtgtgaacggttcgtgcccggcgaaccaccgcaccgccccgtccatcgcctccggccggacgaacgcgctgctcaggaacggcagcagctgcaccagcagggtgaacggcgcgatcccctcggcggtccgggcggccagcccgaccgccaccgcgagccaggtcagtgccacggtcagcagggccagcaggccggccgcggccagccaccgggccgggtccgggtcgccgcggaagccgagggccagtgccaccgcgacgaccagtgtcgcgctggccagggtgcggatgctcgagccgagcacgtgcccggtcagtaccgaggcccgggagatgggcatggtccggaaccggttgatgatcccggcggtcatgtcccggttcaccgcgagcgcggtggtcgtcgccccgtaaccgaccgtcatcagcagaacgccggccaccacgtactggatgtagtcgtcttcggacatgccgacgttcagcgagccgccgaacaccccgacgaacagcagcagcaggaccaccggcaggcccaccgtcatgatgaccgcgcccgggttgcgggacgtgtgcttcacggtgcgtcgcagcatggtcatcgcgtcgctcatcgtccggcctccttcggaccggtcagcgccaggaacacgtcttccaggtcgggggagtgcacggagagctcgtccacctcgatgccgccgcggtcgaggcggtcgagcagctcacggaccgggatccggcgcgggatccgcaccgccagcgcgtcgtcgtcctcccgggacgcgtccgggaagaggtccgctgcggcttcccgcgccgcggcatcccgcaatcgcagccgtacgtgtcctcccggcacgccgcgtttgagttccgccggtgttcccgccgccacgatccgcccgccgtcgaggaccgcgatccggtcggcgagctgatccgcctcgtccaggtactgcgtggtcaggaagatggtcaccccgccggcgaggagttcccggacgatctgccacagcatccgccggctgcgcgggtccagcccggtggtcggctcgtccaggaagatcagtcgcggccgtccgatcagtgtcatcgccaggtcgagccgccgccgcatcccgcccgagtaggtcgccgcggtccgcccggccgcgtcctccagttcgaatcggtggagcagcgcgtccacccggtcccgtctaccggcccggccgaggtggtgcaggtcggccatcagttccaggttctccgccccggtcagcaggtcgtcgaccgcggagaactgcccggtcaccccgatcgcggcgcgcaccccggccgggtcccgggccaggtcgtgcccggccaccgtgacctcgccggcgtcggcgccgatcagggtggacaggatccggaccaccgtggtcttgcccgcgccgttcggcccgagcagcgcgaccgtggtcccctcggcgacgtccaggtcgacgccgtcgagcaccaccgtgccaccgaacgatttgcgcaagccgcgcaccgtcacaccgttgttctcgtccatggtggcagcgtgcgggaggccggcttcacggcggtgtcaccgcggcttcaggcgccgggtctgcagcccggccagcagggcgtcgagggtctcggtgtcggcccagccgttgacggcgatgtcaccggtgccggagacggtcacttccagccggtccggggtcacgtccaccggaagccgatcggtgagatgcacgaactgttgattggtcgagccggcccaggggcgtacgcggtcgatcagatcctgccggaacgggccggcaaccagcaggtcggtggcggcgagcagcccggcgacgccctggtccgcgcgggagcgcagctccgcgtggtcgtaaccggtgaaggtcatcactgtgcgacccgcggcccgcaccgtggcggcgaccgcggccagcccggcggcctggtcgaacggttcgccgccgagcagcgtcaccccgtcggtgccggtggccaggatccgggcggccagctcagccggcggaaccggtgtgccgccgcggggggtgaacaggtgcgggttgaaacagccggggcaacggatcgagcagccctgcacccagaccgcggtccgctcgcccggcccctcggcgcgggtgcgttccaggaaccgggcgacgacgaccggcggcggctcagacatccaccacgcggccgtacgggccgctggtcgtgtcgtccggcggcggcggggccgcgctgcaggtgagccggtcgcggatggcgacgaactcgtgcggggcgaggccggccgcggcggcgaagtcgtcgacggtgaggaagccgcgccgctgctgccgggactgcaggacctgggcgatccggccgggggtgaggccgggcagggtggcgagctgctgctcggtggcggtgttgacgtccacctgcgccggggtggacggctggtggacggccggttgcgggaccggcgccggctggtagcccggggcggtgttgtagaactgctgtgggggtgcgaccacgccctgcaggtacggcggcagcggcgcgaaggacgtcggctgctggcccacccagaccgcccgcatctgcgcctgccaggcctgataaccggccagccagcgcagccaggcgccgttgatcagggcggcgtggaagatgctgaccagccaggcgccgaacaggacggcgtaggagaggttctgccgcagcgagtcggtgggcgcggagccgccgatggtgaacccggcgatggacagcacgctgtagacgatccccggaatccaccaggcgggccggtgggcgcgcaggccgacgtagaggaaaccgccgccggacaggcagccgaacccgaggatcgggaagaacagccacatgctgtgcccgatccgccagccggcgcccggcccggccggcggtgggggctggtaggggccggtcccgtcaggcggggtccacgtcacggttcacctgctgttcctgcacatgctgtgcctggcgcgtgtagtcggcggtccaggcgctgtgccgcaccttaccgccgatcagatcttcgagaacggcaatgtagttcaggcactcctcacccaggatgtcgagggtctccgcgctcacctgaccgtcgccgctgaccgtgaccacgatgcgggggctgctcatgccgtctccacctcgaagaccaggcggacgctcgcgtcgtcctgccgtgactcggactccagccgcagcccggcggccggcgcctgtgcccggatccggtccaggacggcctgctgcacccgccgtccgtacgccgcgtcgaccgcggtgatcaactcgaccgcccgctccacgcccactccgtcggcgtgcgccgaccagatgccgtcggcgtcgcgtccgaaggtcagggcctggtcaccccagcgcgcggtcagcgcggcctcgccgccggacaccaccgcgccggtgtcgcgcagcgcgtcggccagcagggtcacatcgcgcatccgggtgttcacctggaccagcgtctgaccgttcgaccggcgttcggcgcgggcctgcaccgcggccgccccggccagtgccagcggcaccagcagtagtgaaacgctcaccgcacactccccgtctcgttgcggaaatccccatcgtcggtggcggtcgccgggaccgcccggttccgggcccagccgcgcaacgccgcgatccgctcggcctgcgtgacgctgagcgggacgatgctcatcaccgcccgcaccaggtcgtcgcgacgcagcggccggcgctcggagaaggcgtcgaacagcccggcgatcaccgcctgctcgatctcggcgcccgagtacccctcggtcagcccggccagatcggcccgcagatccgggtcgaccagcaggtcaccggccacccgcgggtggcgcagcgcccgggccaggtgcacctgccagatcgctagctagctagcggcccgctcggcccggctgggcaggtcgacgaagaaggcctcgtcgaaccggcccttgcggagcagctccggcggcagcccctcgaagtcgttggcggtggcgaccacaaacaccggccgccgtttctcctgcatccaggtgaggaacgtgccgaacacccgggcgccggtccccgagtcaccgaccgcaccgccggcgaaccccttctcgatctcgtcgatccacagcacgcacggcgccaccgcctcggcgacccgcagcgccgagcgcatgttctgctcgctggagccgaccagcccggcgaagacccgacccacgtccaggcgcagcagtggcaggttccacgcggtcgccatcgccttggcggtcagtgacttgccgcagccggggacgccggtgatcagcacgccgcgcggcgccggcagcccccactccgcggcctcgggcagccacgaaccgttccgcttgaccagccaggctttcagattccccaggccgccgacatcgtccagcacgatctcggtgggaacaaaatccagaaaacccgatttttgtacggtctgctgcttctcgtcgtgcacgatccgcacgtcttccaggtcgagcacggcgtcgttggcgatcgcccgggcgaaggcgttctccgcctcctccatggtcagcccggccgccgcggccacgaaccgctcccgcccggcgtcgtcgaggtcgatccggatccgcccggacgcggcgttcgcccggatcatcgcgtccagcagcccgtgcaggtcaggcgccccggggagcggaaactcgaccagggtcaccgttttccgcagctcggccgggatgctcagcaccggggagagcagcaccagggtgcgcggctgcgagccggaccggaacgcctgcgcggtgtcccggagcagccggatcagctccatgttctgcggatactgcccgtcgacgtgcgcggggtgcaggtcgcggaagacgaagacccccggctcgtccacccgctgcaccgcctgcagggcgccggccgccccgtgcgtgccggagcgcggcttgccgtccggcgggatgaggccaccggtcagcgtccacgtccacagcccccgcggcgtgcgcaccagcacctcgtcaccggcgaccgcggcgatccggtgcagggcgcgctgctcctcgaacgtctccacgtagagcaccgggaaacgggccttgagcagctgcgccaaagtctccgaaaaggacatccggtgcccccctctcccggccggcggatcccgccatcctatggcccacccccaacccgccaggaccgcctcgtccggcccctcgcctcggccgtcaccttgccggccggtgtcccggccggccgtgacgagcgttgcatccggccaagtcgatcttggggcagtggacggcgttggctatcgtcacgcgcgcgggccgcagcccgccgacacaacgggggtaaccggcttcatgaaacgtgcctcgcgagcggccttggccttgaccgccgccgcggccctgctcgccggatgcagcaccgtgcacatggcccgcccccgctccccggaagtgaaactgcccgccaacggcatcgccggcctcgacgcggacgccatcctgtccgacgccgagggagccctgaaagcggccggctccttccgcctgcggctagctagctagcacaccgccccgggcagatccgccacgaccgacgcgcacgggaagccgggccaccacgccccaccgaggccgcgcaccacccccggcggacccgccacgcccggttcgccggcgtcccgccgggaattcgcggcgcccgccccctcggcgcccgcctcccccgcgccgggagcctccacggccggggaggacaccctcgacgacaccggggagaacggcgtcggtgccgtcccgtcgtccggtcccggcccgggcgcccgcggtggcgtcatcccccgtggcgccgtgccacccggcgcgggcagcggcgtcacggccgcttcggccggtccgcggttcgccctcgacctgcgcatctccggcgacgacgtgatcggctcggtctggctgccgcaggccagcgggcaactgctcaccgtgggcggccaccactacgtgcgtccgggtgccgagttctggcgagcggtcgaccccaagggcgtggcccgcaaacgcctgggtgaccgctggctccgcgccgacgccaccgacgtcgccgggatcagccacttcttcgacccggccgtgctgctccgcaccctgctcaagcccacgaccccgttgacgaagaccgccccgctccagatacacggcatcccggcgatcggcctgacgtacgcccccggtgtcaccctctacatcgccaccgccggccgcccctaccccatccaactggacttcccgggcgccgagggcctccgcttcaccgagttcggcgccacgttcggcggcatcaaggtccccgacacctcccgctgcgccgacctcgccgccctccaactgcgctgacccccggaccgcccggctcgatcacgcagcccatttcccgggcggcaccggtacacggtcgcgctgacgtcggccgtcccggtccggctccccctttcgtggctgatcgtccgagtggagttcggcccggtctcccgggcccgacctcggtcgtgctcccggctcggatcccccgggcgggcgtgaccggcccgccgtccgggctgcgctggtctctcacgcggcacggctccggcgcgcgggtcgggcgcgggcgaatggatggtggtgggcgcggggcggcgctgggtcaagcggtggggacgaaggggcgcatgaaggtgcggtcgtagtggaggacgcaggggccaactacgtgccagcagccgcggtaagacgtagggcgcgagcgttgtccgatggcgtagtgcactacgcaggtgatcaccggctcggcctaggagtcgccgccggtggggccggaccaggcccagtgcggcatgggcagggcgtccgggacggtggccgaggccgggaacacggcggcgacctcgcgggtggccgccaccatgtagtcgtgcagggcgccgcgcagcgccgggtcgtcgggcagggtgtgcgcgaccgcctcgtcgaagacttccaggaaccggcccgagaacgggtcctcgtcgcactggttggcgtggatccgcagcatgcccgagtggccgccgtgccggccggaataggtgggcggcccgccgaacacctcgccccagtacgcggccaggtgctggacgtgctccgggtcgtcgaggtgcgagaacgggtgctcgaggaccgggtcggccaggcagcgcgcgtggaagtcggtggcgagggcgagcattcccgccgccccaccggcggcctggtagagcgtggagcgtcccatcagcccatcttcggcccggagctgccgggtggccaggtccccccgcgaacacggcacgtcgggccgggcgcggcccggtcactgccgtaccgccatatcggtaaaatcggacgtataggggtgggtgggcggggtaagcgtccgggaatgatccggtacggggacgaggtggcgtcgatcgcgcgggagctgcgggacccgggtgatctggagattctgctcgatcgggcggagtcggcgcggatcgtgatgatcggtgaggcgacccacggcacgcacgagttctacgcctggcgttccgttctgacgcagcggttgatcgaggaacgcgggttttcgttcgtcgccgtcgagggggattggcccgacggagaacgggtcgacgccgcggttcgtggcggccccggcgctcccgatgatccgcggtcggcgttgatccgctacgaccgttggccgacctggatgtgggccaatgaggaatcggtcgatttcacgcgctggctgcgcggcctgaacgccgtccgcccgcccggcgagcgcgtcggttttcacggtctggacgtctattcgctgtgggagtcgatgcgggagatcctcacctgggtgcgggagcacgacccggatctggtcccggtcgcgctggatgcctaccgctgtttcgagccgttcgacgaggatccgaacgcgtacggctgggccacccagttcgtcgacgcgacctgtgcggaggcggtcgtccggatgctcgccggcctccgcgggcgggatttcggggtgtggcagaacgcggccgtggtcgccggagcggagagttactaccggaacatggtgcgcggcggaccggaggcgtggaacggccgcgaccggcacatggacgagacgctggatcgcctgctcaaccactatgggccgggatcgaaggcggtggtctgggcgcacaacacgcacgtcggtgacgcccgcgccaccgaccaggtggaccacggcgaggtgacgctgggtcagctggcccgggaccggttcggctgggacgaggtgctgctggtcggcatgggcacgtatcgggggagtgtggtggccgggccgcagtggggcgcgccgatggagatgatgggggtgccaccggcccgggccgggtcgctggaggagatcctgcacctgaccgcgccggcccggggcctgttcgtcttcccggccggctcggacggcccggacctgctcaccacgatcctgccgcaccgggcgatcggggtggtgtaccggccggagcgggagcgctgggcgaattatgtgccgaccgtgctgggcgatcggtacgacgcgttcctctggttcgacgagtcgcacgggctgcggccgttgcacacgctgcgggtgaacacgcacgagccggagacgtatccgagcggtgtgtaatcggttttgaagagctgattaattcgatctttctaatgacgttcatccatcagcctagtgacgtgggcggacaactgaagggtcagacatctctagccgggaatgctcctgcaccgtgctgtgatcgggattacgctgcgttctaccgatcatccatatcggatcgacaggatcagaaatgaaacagaacggaacggggtgtccatgaaaaagatcgtccgcctgctcctcgccgcattgctgagtgcgtgcggggtgaccgtcgtggcggccggaccggctgccgcgacgctggcgtccgggtacgtgctgagcagttcgaccgccacccttccggccgagctgtccgccctcgcgaccggcaagcgcgtgcagtacctgtccacctcgatcaccgggagcacgatcaccgccaccgggctgatcctcaccccgaagtccggtaggaagaacagggtcgtcgcctgggcgcacggcaccaccgggctcgcctaccagtgcgcgccgtcgaccaaccagagcgtgttctgggaggaggcccggatcgcggtcgccgccctgctcaaccgcggcttcacggtcgccgccacggactatccggggctcggctcgggtggccagcacccgtacctgatcggcgccagcgaggctcgcgcgatcatcgacagcgtcaaggcggcccgcaacctcgacgcgtcgctgagcacccagtacgcgatcgacggccactcgcagggtggccagggcgcgctgttcgccagccagatcgcccccgcgtacgacggcaatctggtgttggagggcacctccagcatcgccccgctgtcgaacgcggacaccatcgccccgttcatcccgggcacggccgagcagggttacctggtgatggcgctgtacggcctgaacgccgtcgacccgagtgtgcagccgctgaccatcctggccaccccggccaaggccaaggtgggcgtcctctactcgggctgtctcaacgagatcctcgcctcctaccagagtctgaccgccgcccagctcgtgaacaacggcgtggtgccggattacgtgctgaccaaactcgcgcagtacgacaacccggcgcagtccgccccgaccgcgccgatcctggtggtgcagggcaccgcggacgaggccgtcccctacgacatcacggccggcatgctgatcccgcaactgcaggcgtacagccagccggtccagttcgtgccgatccaggacgcgacccacgacaccgcggtgatccagtccgcggacctggtcgccgactggatcaccgcccgtttctcctgatcaccccgtcgccgcaccgggtgacccggccgacccacgtcaccgatcgaccagcccacggaccgccgtcagtccggcggtgtggctgaccagcccggccggaccgccatcatcctggcggtcttggccgggtcccggtcgaccaactcgtcgagcgcctcgtcgatccgcttcagcagatcatcgccgagcggcacgccggaggcggccgcgttctccgtgacctgctccggccgggacgccccgatgatcgccgcggtcacggtcggccggtgcagcgtccacgccacggcgagctgcgccatcgacagcccggcctccgcggcgaccggccgcagcgcctgcacccgctccagcagccggtctccgagcacccggttgatgaaccggggcgcccgcccgccggccgccgcccgggatcccggcggcaccggctcgccgggacggtacttcccggtcagcaccccctgggcgagcggctggaagaccacctgcccgatgccggccgcggcacagaccggcaccacctcggactcgatcacccgccacagcatgttgtactgcggctggttcgccacgatccgggcccgcagcccggcactcgccgcgatcccctgccgcagctgctcggccgtccattcggagacaccgacatacccgatcttgccctgcccgatcagggtgtcgaaggcctcgaacgtctcgtccagcggagtgcccggatcgaaccggtgcgcctgatagaggtcgaggtggtcggtgccgagccggcgcagcgagtcgtggcagctctggatgatgtgcttgcgggacagaccgcggtcgttggccccgtccccgaccggcaggcacaccttcgacgcgatcgtcaccgattcgcggggcagcccccgcagcgcccggccgagcagcgtctccgcggccccctgggcatagacgtccgcggtgtcgaacgtgtcgatcccggcgtcgagcgccgcccggacgcacgccgtggccgcggcctcgtcgaccgtctccccgtgggtgagccagttgccgaagatgacctcgctgacgaacagcccgctggtcccgagtcgtcgatgctccacgtgctcaacctatccctcgatggcgggctgtcgatgccccacagtgctcaccccgggccgcgggggtgaccggcgtggcagacggcgggtgtcatccaggtgtcggtccgagccggctcaggacccggtcgagggccgccaggtcctcgggcggcagggcgagcaactcgggtgggggagtgcccaggatccggttcgcctcccgggccgcgtcccggccggccggggtgagcgtgaccaggcgggaccggccgtccgccgggttcggctcgcgggtcaccaggccgcgggccgccaggtcgccggtgatcaccgtggcgtagggcgggtcgcagccgagcagccgggccgtctcgctgagcgtgtggggacctccggcgagcaggagcagagccttcacgcggacgaaactcaatcccagcgccgcgctgacctggaccttcgcgtcgtgctgttcggtgacgagcgcgcgcatcgcgcgccaggcgcgctcggcggcgctcatgccgggacgctttccgcggtacgcgtgtgggtgcgcgccccgtcgcccgtgctgagccggccgagcaccagcaccgccgccccgagcccgcacaggatggcagcgccggcgtgccggtgcccggaggccagcaccgccccgatcaccgcgaccccgagcgcgctgcccacctgtcgggacgtggaggcgatcgccgccgccacgccggcccgctcgcgcggcatgccggcgaccgcggtggtggtgatcggcgcgttcaccatcccgaagccgatcccgaacagcagatagccgatcagcagctgccagaccggggtgtccggtcgcgcccaggtcagcgggatcggcccgagggtcatcgccgccccggcggccagcagcggcagccgggttccccggctcgccaccagccgcccggcgaacggcgagaccagcgcggtggcaccggccatcggcagcgtccagaggccggcctgcagcgccgacaggccccgggtctcctgcaggtagagcgtgttcaggaagaggaatccgcccagcccgccgaacgcgcagatcgcgatcagcaccgccccggagaacggcgggctgcggaacaggccgagatcgatcagcggctcggcgcgacgcggttcccaccacagcagtccgagcagggcgagcagcccggccgtgaaacagcccaggatctccggcgaccaccagccggcccccggcccctcgatgatcgcgaaggtgaccgtggccagcagcaccagcaccaggacctggccggccgcgtccagccggcggggtatcggggcccgggactcgggcacgaacagggcggtgaggatcagcgccgcgacgccgaccggcacgttgatccagaagatcgaccgccagcccagcccgtgcaccaggaaaccgccgaccagcgggccgagcgccatgccgaagccgaccaccgcgccccacacgccgatcgcccgggcccgctcgcgcggctcggtgaaggtgttcgtgatgatcgacatggcgaccgggttgagcatcgagccgccgatcgcctgcagtacccggaaggcgatcagcgcctccagatgcggtgcgaggctgcacagcagggaggcgacggtgaacagggcgagaccggtctggaagacccggcgccggcccacccggtcggcggtcgcgccggccagcaccaccaggctggccaccaccagggtgtacgcgtcgatggtccactgcaggccggagaccggggcgtgcagatcgtcgcggatggccggcagggcgatgttcatgatggtgacgtccaggctgatgatcagcaggctcatgcagcagatcgccaggatcaggtaacggcggggcacgtgttagttgtacccgtataactaaaggatggcgcgcgggatgttggtcacatcgacaccgggttttcgagcggacaccatgtgggcatggtggcgggcatgaaaatctggccgggcaacccgtatccgctgggtgcgacctatgacggcggcggcacgaacttcgccatcttcagtgaggccgccgagcgggtcgagctgtgcctgttcgacgacgagggcaacgagacccgggtcgacctgcccgagcgcgaggcgctggtctggcacggctatctgccccgggtcacccccggtcagcggtacggtttccgcgtgcacgggccctacgacccgtcccgcggcctgcgctgcaatccccacaagctgctcctcgacccgtacgccaaggccatcgacggcgactaccggtgggatcaggcgctcttctcgtacgacttcggcgacccggcgtcgtacaacgacgccgactcggccccgttcgccccgcgctccgtggtgatcaacccgttcttcgactggggcaacgatcggccgctcaagatcccgatgtggcagacggtgatctacgaggcgcacgtcaagggcatgacgatcaaccaccccaagatccccgatgacgtacgcggtacctactccggcctcgcgcaccccgagatgatcaagtatttccagcgcctcgggatcaccgccgtcgagctgatgccggtgcaccagttcgtgcacgacagcggcctggtcgagcgcggcctgagcaactactggggttacaacacgatcggcttcttcgccccgcacaacgggtacgcgtcgttcggcggcgccggcgggcaggtgcaggagttcaagtcgatggtcaaggccctgcaccaggccggcatcgaggtgatcctggacgtcgtctacaaccacaccgccgagggcaaccacctgggcccgaccctgtccttccggggcatcgacaacccggcgttctaccgcctcgtcgagggcgacaagcagtactactacgacaccaccggcaccggtaacagcctcaacgtccggcaccacgagtcgctgcggctgatcatggattcgctgcgctactgggtgaccgagatgcacgtcgacggcttccgcttcgacctggccgcctccctggcccgggaattccacgaggtggaccggctggccgccttcttcgacctggtcaaccaggacccggtcgtctcccaggtgaagctgatcgccgagccgtgggacgtcggggacggcggttaccaggtcggtggcttcccgccgaactggaccgaatggaacggcaaataccgcgactcggtccgcgacttctggcgcggcgaaccctccagcctcggcgagttcgccagtcgcttcaccggcagctccgacctgtaccaggacgacggccgccgcccgatcgcctcgatcaacttcgtcaccgcgcacgacggtttcaccctgcacgacctggtgtcgtacaacgagaagcacaacgacgccaacggcgagggcaaccgggacggcgagagccacaaccgctcctggaactgcggcgccgaaggcgagaccgacgacgccgagatcgtcgtcctgcgcgaacggcagaaacgcaacttcctggccaccctgctgctcagccagggcgtcccgatgctcctgcacggcgacgaactgggccgcacccagcgcggcaacaacaacgtctactgccaggacaacgagctcagctgggtcgactgggagaatgcccgggaggaggacgttctcacccacttcacccgcctgctcctgaagctccgcgccgagcacccgatcttccgccgccgccgcttcttcaccggcgccttcgccgacgagaacaaactccccgacatcgcctggctgcgccgcgacggcgaggtgatgaccgaagccgactggaacaccccgagcggcatgacgatgaccgtcttcctgaacggccacggcatcccggaacgcggcgccctcggcgaggagatcaccgacgactcgttcctgctgctgttcaacccgctcagcgaggacgtctcgttcaccctgccgtcccgcgactacggcaagacctgggagatcgtcgcccacaccgccgatccgctgctggcccgccgccgcaagaccgcccgcgccggcagccgcgtcgacgtcctccgccacgccctggtcgtcctgcgctgccgctactgacccgctcggccggggcgttgcggactccgcaacggcccgcgccgcggtgtctgtgggaaatccgctggcgccgcggcccggccggtgctgggctggcggcgtgacgagaatcgagcgccggtcggatccggtggcgaccggacggattctgcgggccctgccgtcctggttcggtctcgaggaggccgtccgcgactacgtcggcgacgcctccgtgctgccgagctatctggcggtcagcggctcggcgacgatcggggtcgccctggtccgccggcacttccccgaatccgccgagttgcacctcatcgcggtgcacccggacgcgcggggctccggcgccggcacgctgctcctcaacgcggtcgaggaggatctccggtgcgcgggtgtccggctcctccaggtcaagaccatcggcgcgtcgtacgagcatgaggggtatgcgcagacgcgcggcttctatcgcgcccgggggttcctgccggtggcggagatgcgcggcctggtctgggacgggccgacgctgctgctggtgaaggtgatcgccccggatccctaatggacgctgctgatgatgacgctggtctccgcggtcgcgctgttgaccaggatgccggcgcactctcggtcgtcggcggccatccgcaggagcgcgtcgccggacatgccggcgttgaacacgggcccgaaccggcgggcgaacacctccgggtcggcgaaggtgaggatccgctgccggccgtcgccgtgaccggtccggcgcacggccagggtgccgtccgagacgaagccgcccggcgcgtccggcaccggtgtcccggtgaccacgacgccgacggtcgaggaccggaagagcgcgacgaaccgctggtacgcctccgcgtcacgggtctgcgcatgctcggccatgacatccgacaggggtgtgtcactcacgatcgcgaaccctacggcaacgccggccggcgccgcccgccgtgatcggtcgcggacggcggcgaggcgggagcggaggccgatcactcccgccagggtggctctgcctacccccggccgagcagctccagcgtccgcgggtcggggccgtcgtagaaccggtcgaggacctcgccgaagacgcccggctcggcggccgccgcggcgaacagggtcatcgacgagcgcagcttcagatcgtccggatagccgaggatctgctcggccgtgcgaccctcgacgcccagcagcgtgcgggcggcatcggtcagccgggcgcccagcaccggatgcgccagataggcacgggcctcggccaggtcagcgatcgcgtaggcctgcgcggtggggctcgaccccagaccggtcaactgcggaaagacgaaccacatccagtgtgtacgtttacggcccgcggccagttcgtcgcgggctcgctcataaacgccgtcctgggcgcggacgaagcgttccaggtcactcatccccccgatggtaatcgtgtcgccggccggagccggcgatccgcgcgatgtgcgcgccgggctcgccgggcaccgcgcggcgggccgcgccgagaccactcaccccctcgacggtgacctcgacgatgtccgcgtcggccagcaccgtggtctccccgccggccggcatccgcaggatcaggtcgccgtggtcacgcagctcgccggcgtccgcggtcaggccggtgaccccggtcaccaggtatcggtcgaggtgcgggtgcggggtggcgagcaggctggtaccacgcaccgacaggatccacgggacgctcagcgcgcccgcccacgtggagccgccgacccgggccagcacgcagcggcgcccggcggcgtcgacgaagggcgcggccggccccagccggccccggccgaagacgccccgggcgcgcggccggaaggcgacaccgtcataaccgccgatggcgtacgacgcatcggcccccgccacgagcaacacccactcgccgtcgagttcgaacagccgcgggcagtccacctgcccgcccgcggcggtggtcagcacaccgtcgtacgaccagtcgtccagatccgcggaacggtattgcaggaccgcggagccgcccccggccgcggtggcggcgaccagcatccgccaaccgccaggtgccgcgaagacgaacggatcgcgcacgtcggagaagccctccggggcggcacccagcaccggctgatcaggatcggccagccagcccgtcagatcggcggcggcggtggcccggcgcaccccggagcccggaccggaatggaagagcaccggcccggacgggccgtcgacgaccgacccgcagcccgggccgccgggcgcggcggcgaccgcgccctcccgccagatcaccagatcgtcggagacggcgcagccccagccggcgtcgccgccggaccggtgctcgtagaacaggtggtagcgcccgtcgcggtgcagtaccccgaacaggtcgccgacccggccgtcacgcggcgtgaaatgcatccgggggcgcggtcccggtccgacatccatgcctctgcgtaacatcaccggcgcgcccgcgccaccccgtccggctgccgatcagtcgtcgaactcaccgtccttggcgccgccgacgaacgccgtccactcgtccggggtgaagaacagcaccgggccgtccgggtccttcgagtcacgaaccgcgcggccaccgtcggccagatcggcgacctcgacgcagttgtccgaatagctgcgagtactgcgacgccagcatgccccgttccggtcaaagctcgcagcgtaggtcttctctgtcatcttgcacctccgggcacattctgagcatcgccgtgccccggaaactgtccgagatccgtcagccccggacaaacggcatgccggtcagaacagcgtcgccggcccctccgcctcccggggagccggttccggcagcggtggcaggcccggtaccagggcggcgacctcggcgtggaaccggcgggccagatccggcgcgtcggcgttgtccggggtgtgcaggaagaccgtcggggatcggccctcccgcagccagccggcggtcgtcgcgacccacggctgccagccggccaccgtgcgctcggtgtcgtcccggcccagatagcggacgatcgggtggtcggtcagcgcggtgtcgcggcgtggcatccggggtttcttcaaccacgcgtcccgttccgcggcgctcgtcggcgggctggcgaagaacgtggtcgtgtcgaacggaacccattccgcgtcatgcgcggcgagcagttccgtcagacgcccgggatcggtgaagaagtccgggtggcgcacctccacggcgtaccgccgatccatcggcagggagcgcaggaaccgggagagaacggcgagatcgccgggtccgaaggacccgggaagttgaatccacagagcggtggcgcgcggcccgagcggctccatcgcgtccaggaagacgcgcaggtcctcctcggcgccggacatccgcagctcgtgggtgatccgtttcggaaccttcgggatcaaccggaagtccggagcggtctgctccgcccaggtggccaccgtcgcgcgggccggcgtggcatagaaggtggtgttcccctccaccgcattgcaccatccggcgtacgcccgcagccggtcaccggtcgcgaaacgcgcctgccacgccttcaaggaccacatcgcgcagcccacatgaagggccggaacaccggtacgcacgacgccaccgtagccgggcgcgcggaagcgacgcctggtaccgtgccgggacccgctcgccagaaggagtcctcgtgaccgattccgtgggccggatcggcatccgcgccgcgtccgccgcactgctgctcgccggtgtgaccggcggcgtctacctgggcgagcaccgaccgccgccgaccagcggcaccctggactcggtgcaggccgaggcgaacgacatgcagctgctcaaggatcggcagaacgaccacgccgcggcccgcgcccggatcaccgcggccgagggcgtcgccgcgcagaaggccgcgtcgaccgcccgcaccgcctcgggatacgccaaaaccctcgacaagcaggccaccgcggccaagaaggcggcccagaagccgagcggcccggtcgccttcgccggcccgattcccggctcctgcaccgaattcagcggcagccgggcggtcggatgcgcgctcaccctgcaggccggcttcgggctcgaccagttcgcctgcctgaacaagctgtggaacaaggagagcggctggaactaccgggcggagaaccggggctcgggggcctacggcatcccgcagtccctgcccggctccaagatggcgtcgttcggcgcggactggcagacgaatccggccacccagatcaagtggggcctggactacatcaagaagcgctacaacaccccctgcaacgcctgggcgcactcggtccagttcaacaactactagacggtgatctatctcttgttgcccggagagggtcgcggtggggcagcgccggccgtgaggttgcggtaagactgcatcgatcgatcctcccttgtggaggacgtttcaacgatgcagcggtcactccggccgttgtgatgatggtacgggggttccatcgtggcgttgtggacgcttcgtcgtgcggttttaccgcccgcattctccaggaaacgggtccgtctgcgctgggccgcgggtctggcggccggcctggccgtggctgtggcggtgccgggtggcgccgcgggtgcaggcgccggtggtgcagccgcacgcgctgaccgtccaggaggcgctgcagcaactgctgggcgcggacaccaaggatccgtcaccggctgatacgccgatcgacgacgccgacctggatcggatgctgacccaggatctggcggattacgacgcggatccggcggtgcgggccgctgccacggcggtgctggccaccaatgatccggcgcagatcaaggactttctggacaacgggctgccggtctaccgcaaggccgatcagcagcgccagaaggaccaggcggaccacaaccgggttcaggtccaggagtgggtcgtctccggcagcccgaccgtgcggcagcgggcgcaggccgctctggactccaacgacgatgcgaagatcgccgcgttcgtggcgaccgggcatgacgccgccgatctggcggacaagcaggatgcgctgaacgcggcgcagcaggccaagctgatcccgagcagatggtcgccaacggtggctacgaggtgcagaagctcggccaggccgcgctggacagtgaggacccggtggtcatcgccgagttctacaacaccgggtacgcggcggccagcaagcaggacgcggacgcggagcagcagatcaccgacgcgctcgcggcccggtccaaggcggtcgccgacctgaccgatctggcccaggcggccgggaagccgttctgcacaccactgctcatcacccgttctgggacgccggcacccgaagctggatcgatgccggactgttgagggccggcgccactcttcgcacgccgcgcggcggcactgtcaaggtcaccgccgttcaccgcttcctcggtgcccggacgatgcacaacctgacggtcgccgatctccatacgtactatgtgctggccggtggcacccctgttctcgttcacaactcgatactttgtgatatccacgggaatcctatcgatgacagtgagccgctatatgggccattccaccggctccaatccccgactcagagcccggctgtagcccagcaaatcttggagagcagccaattgtggggcaaggagccccgtgtgggactcattgatataccgcagccacaggcgcatctcgggccgctgcccgagggggccgcaggggtggagttctacacgggtatccctccggggccgccgtatccagggcaggtcagatggctcggcggttccccgggtgtgccgatcgaggatgggtacgcgaagcttccgattatcatcaccaagtacacccaataggagggctgccttgaatccgctggaagggccccacgtttctgttcggtcgaccgacgggctggtctccattaccgtcgatcgggtgaccgcggattatcttcgctacgccattgcagtattgggcgagcatgtggctgctggaatgaaggttcctcctatgtcggcggacatggctaccaggctggggaatctgatgaatgaggtcgaggagtatttgagagcgcactgaggcggccgtcgtgcgatcgtgcgtctggaattcgtgaggcgccggtgaccgggttgctcagccgatcaggttgagcaacccggatatcgcgaacggcgacgtgcgcgcggtcacggcggcggaaagtcgcagcggatagggtcgccgcatggtggaggcggttttgttcgactgtgacggggtgctggtcgactcggagcggatcacgaacgccgtgttgcggggcatgctgcacgagctcgggtgggcggtcggcgaagccgagtgtttccggctgttcgtcgggaaggcgctcgccgacgaggtgggggtgatcaccgcgcacaccgggttcgtggtcaccgacgagtggatcggcgagttccggcggcgccgcaacgaggggctgctggccgggttggagcccattcccggggcggtcgccgcggtgcacgaggtcgaccgggctttcggcggccgggtggcggtggccagcggcgccgaccggttcaaggtcgagttgcagctcaccaaggtcggcctggacggcgtcttcgccgggaagatcttcagcgggatggagatgccgcgcagcaagcccgccccggacgtctatctcgcggccgccgcggcgctcggcgtcgatccggcccgcgcggcggtcgtcgaggacaccgcgaccggcgtgcgggccggggtcgccgcgggtgcgaccgtgctcggctactgtccgccggacagccccgcccaccacgcgccggaggttctcctcgcggccggcgccgcccacgtcttcaccgacatggcgcagcttcccgccctgctcacggcgatgcctgcagatcggccggcgcccgcatccgccaggcatcggtgatcagctcggcgagccggtcggtgctcacccgcggcagccggaccatgaccagcgggagcccgtcgtagcccggcgtggtgaagaacagctccggctcgccgagcagcagcgcctgtttctccgcctcgtcgccgacgtacagcacggcgatgtcggtgcggatcacccgcggcctgccgggcaggcgttccgggtaggaccagatgaaccccttgttcgccacccggaagtcgaacccgtcactgtcgatctcggtgacctcgggcatcgccagggccagccggcgtacgtcgtccgcgtcagccatggctgtgagactagtgtgtcggggtgaccgagcagatctgcgaagtggtgatcacggcgggttcggcggagtggctcgccgatttcacccggcgcctggtggagcggcggctcgcggcgtgcgggcagatcacgccgcaggtgcggtcgatctaccgctggcagggtgcggtggaggacgagggggaggcgcgggtcgcggtgcacacccggctgtcgctggtcgacgcgatcgtcgcggcggccgagcgcgagcatccctacgacgtaccgtgtgtgctggcccttccggtcgtcggtggaaatccgcggtatgtggcgtgggtcctggagcagaccggtcaggagatcgccacgtcgaccagccgcgactgatcgttcaccccgttcccggcgagggtcacgatccgcaccgctgtcgtcgcccgcgccgtgaaggtgctgattttcagggcggagcgattgccgcgtacggagtcgacggtctgccagccggtgggcaccgcgacctgcacatcccagtcgcgcaggccgccgtccgcggtggtggtgaccgcgatccggctgacccggtgtgccgtgtcccagtccagctgccaccagtccggccagcgtttgccggtggtgtcgttccacatggtgtccgcccggccgtcgatcgccgcgcaggccggggaaccggcccgcgcggaggacgcggtgacccggctggcgagcctggtcagggcggcaccgggcgcgggggtgcccacccggatcggcacttcgacgcggctggggccggcagtgacgcgtacgcggaaatcgcccgcgcgggtcgcgcggaccgcaaccggaacgctgctcgtgtaaccggccgggagccaggtggtgatcagcgagcggggaaggtgaagcgccgggtcggcgctgagcgaagcgtcggcgtagatcggggtctttccgtggttggtgagtttcaccgtgatggtgccgccgttgcactgtccgatcgtgatcggcagcgtcgccggggccaccgtgatcgagaccgggggagtggcggacagcgccaccagcgccaccagcgtcgaggagatcatgccggcaccagcccggcccgggcccgttcggagatgaacgacgcccgcgtggagatcgtcccgccgcgccgcgtcacctggttcatcacccggtagtcggcccgcatcacgtcgcgtcccagctcgcagagcacgtagccgcgctgtccgttggcgagcttcaggtgtgggttgtatcggcgctgcatgtcgagttgcgcggtggtgtcgctgccgtcgccgccgctggagatcgacgtgcccacgagctccacggcgaccggcggggtctccggtctgccgaagtcgagccgcaggtcacaggcgtagttgttgtggatgtcgccggagacgacgaccgtgccgggcatccgcgcggccagttccagcacccgctgccgatcggcggagtacccgtcccacttgtccatgtcgaggcggttcgccgggccgccgtagacgcaccgggccatcatgatctgctgggcgagcacgttccagcgggccggggatcggcccatccggccgagcagccagtcccgctgcggtgccccgagcagggtgcgctgcgggtcgtcgcgggcggtgcaaccggcccgcaggttgtcgccgcaggcctggtctgaccgatactgacgggtgtccagcacgtaggcgtgtgccagatcgccgaaccggaaccgtcgatacagcgacatgtccggaccggacggttgtcgcggccagcgcagcggctgattctcccaatatgcccggtacgcgttggctcggcggaccaggaagtcccgcaccggcgtggtgacgaagcgggagaccccgtcggcgtagttgtcctgaacctcatgatcgtcccaggtcaggatccacgggaaggcggcgtgcgcggcctgcaggtccgggtcggtgcgatacagcgcgtaccgcatccggtacagatcgagggtgtccgtctccagctcgaacgtgtccggaaggtgcagcttcgggtccatccggctgccgcccgagctggtgatcgcaccctcgtagatgtagtcgccgaggaacatcaccaggtcgagactctccgcggccaggtgccgccaggcgtcgtagtagccgtcgccgtacgcctgacaggaggtgaccgcgaagcgcagtgcccgcggcgtggcggtcttcgccggtgcggtccgggtccggccggtcgggctgaggaagccctggctgcggaatcggtagaaatagtcgcggccggggcgcaggccggtcacgtcgacgtgcaccgagtgcccgtagccgggggcggcggtcccggtgccgctgcggacgacccgggagaacttcgcgtcctcggcgacctgccagtccaccggatagctcaccggcggcagcccgccggccggctccagcgggcgcggcgcgagccgggtccagagcagcacgcctccgggcagtggatcgccggatgcgacaccgagcgtgaacgggttcgtgagcctcggccgggggagggcgccggccagcgccacgccactcagcgtgaagagccgccggcggggaagttgcagcatacccactcccttttcccgatatttccgacaactctatcggtgagaggatggtctgggtcgcggtgttggtccggtgtacacaaaccggaaatcggtcttccctccggagccgtccggaatgtcattgtggcggtacgcccacccgaaccagcaccattctcacttttggtcccgtcggtgacgaccgggtagcctctgccgcgccatgccagaccacacccccacccacgccccctccgccgtcggccccgacccggacgccgccgtcggcctggcgccggccgcagcccatccgtcacggcggcggctggccgtgatcctgggggcggtgctcgcgatcctcgccgcggtgaacgtcgccgacaagtacggcccgcaccacaccggcctggtggccggccccacggtggccctggccctggtcctgctcgcccgccgcgccggcctctcgtggcacgacctcggcctgtcccgccgcaccctgctccccggcctgaagtatgcgatcggcgccgtggccgtcgtcgccgtcgtctacacgatcggcgccgcgatccccgccacccgggtcgccttccacgatgtccgctaccacctgcacccgggcgccgccctgctcaccgcgttcgtcatcgtcccgctgggcaccgtcctgctggaggagatcgccttccgcggcgtcctgctcggcctgatccaccgccaccgcggcgccacctgggccagcatcacctcctcggtcctcttcggcctctggcacatccttccgtcgctgcgcctggccgaggtcaatcaggccgtcggcggcaccctgggttccggcctccccggcaccatcctggccatcctcggcgcggtcgctttcaccgccatcgccggcctgctgctctgcgaactccgccgccgctccggcagcctgctggccgccgccgccctccactgggccaccaacggcctgggcctcctcatcgccgccgccctggccaccaccaccctcacctgatccacccgccctgggccgccaccgtcacctgatccacccgccctgggccgccaccgtcacctgatccacccgccctgggccgccaccgtcacctgacccacccaccctgggccgccaccgtcacctgacccacccaccccgggtcgccgctaccctcacccgaaccaccccacccgcccgggcggccgccgccggggcggacccctcaccgccccgccgcgcacggacaggccggtagggtcgggggtatgcgtgttcccactgctgtgatcactgccggctccctgatcggcggctggcaggccgcccgccgcaccggcgtccgccccctcggcggcctggtcctcgccgccggcggcgtcctcgccggccgcgagtggtcccgccgcaccaccccggccgtcaccggcgccctcgccgccacctacctcggagccttcggcctgtcccaccctctggccaagaagatcggcgcctggcccgcggtcctcaccgtctccgccgtcaccgccgccgcctcctacctcgtcgccgaccgccgctgaccggtcccgagaccgcgccgccgcctcctacctcgacgccgaccgccgctgaccggtccggagaccgcgccgccgcctcctacctcgacgccgaccgccgctgaccgggctcgaaaccgcctcgaccagcggggccggcaccgggcccacccgccgatgtcaggatgtcactggtagacccggacgtagtcgaccagcatggtgctggggaacggggtgctgctgtcgatcggcccggggaagtcgccgccgaccgccaggttgaggatgatgtagaactggtggtcgtagatccacggcccgcgggtgttctccacggtgtccttgacggcgttgaagaccagggtgttgtcgaggaagaatcgcatccccttgctgtcccattcgaccgcccagacgtggaagtcctgggacaggtcgacggtggaatacttctggccgtatccgccggccccgttgtaggcgggggcgtgcagcgtggagtacgactcggtggtgttgcggccgagcacctccatgatgtcgatctcgccgttgtacggccatgggcgaccggtgaggaaatcggcgcccatcatccagaaggccggccacaacccgttgcccttcggcaccctgatccgggcctcgacccgaccgtactgcaggctgaacctgttgctcgtgttcatccgcgccgaggtgtattgacggccctggtagtcctcgcggcgggcctggatgacgagctggccggcgccgttcatcgacgcgttggcgctgtccggggtgtagtactggacttcgccgttctgcgggacgcccgggtcgtacgtccatttcgtggtgtccggtttggcgccgccggcgccgttgaactcgtcgtcgaagaccagtctcgtggccgggaacgccgggtcggccggtggggcgggcgggtcgaccgggttgccgccggtgccgtacacgctgaactcccagagcgaatagccgtacgggccgccccgcgccgtgccgtacatccgcacgtagcggccggtgccggtggcgttgatgacgtccttgaggccgtcgccggtggtggtggcgtagatcgaggtccagttcgtggcgtcgttcgacacctggatctggtacgccttgccgtacgccggatcccactgcagcaccacctggctgatctgcgcggtggcgcccaggtcgacgtagatccagcccgggtcgacccagccgttcgtcgggctggtcgcccagcggcttgccgggtcgttgtcgaacgccttgtcggccgtgcacgggttgcagttggcgtcgttctgttcggacgaggcgcgcgccggtttggcgtacgacagcaatcggggggtggggttggtggttccgccgccggagaacacctggaattcccagaacgagtatccgtagaggtcgagcgcgcgggcggtcaggttgatccggacgtagcgcgcggtgccgctgaccgggatgctctgctggccgccggtgccgctgctggtggcgtaggcctgggtgtacgcgctgccgtcgccggagaactggatcgtgaaggctttcgcgtacgcgttctcccagttgatcgcgatccggctgatcgcggtgggcgcgccgaggtcgacctggaaccactggccggccgcgaacgcgctggaccagcgcgtgccgttgtcgccgtcgacgccggcggtcgccggggtgccggcccattccaccgacgacgcggtgaccggcttgttctgcgagaccagggtttccgcggcctgcgcggcgggcgcgccgaccggggtggcgaccagcccggtcagcgcgaccagcgcggtgagtattcgttgtcgggcagggggcatcgacatggggactcctgcggggttgtgtcgaagctgtttccagccggggaacaggctgtgaaatcgctctcttgcggcacactctgaacgcgctcccatgcactgtcaatgggccctcggaaccggttccggcagcggttccggcatcgatgcaggtcaccgggcgcttccgtcgacagcggccgatgaagttccggaacccgacggctcatccgccatccgccgagcgcggcgtcgccggcaccacgcaccgggagattgcccgcgccgccgacgtgccgctcggctcgatgacgtaccacttcgcctcgctcgacgaggtgctcgccgaggccttcacccggcacgccgaggccgccgcgaaggtcttcgacgagcggctcggcgcggcgaccgaccgggcgagtgcggtcgaggcggtgatcggcctgatccgcgacgacctgatcggctcgccgtccgacctggtgctggccgtggagttgtacgtgccgcggcccgcaagccggcgctcaaggcggtcacccaggcctggatgccaccggatcaatgccaccggcttgacgccggccggcgcgggcgcgtcaggcggcgaccgcctccggggtgggggagtcctgccagaccgcccagcgggtgtccgggccgagtgccttcgcgcggcgcatcgccgcgtcggcgcggtgcacgagctcgtcgtgggtgagttcgcccggtgccgacaccgcgaccccgatgccggcggcgagggggaccagccgaccggcgaccgcgaccgtgcccatcgccgcggcgatccggccggccgcctcgtaggcctggccgggaaaggccagatcggtcagcagcaccgcgaaccggtccccgccgagccgggccggcagcccgggagccggcaccgactgccgcagcacctcggcgaaaccggtcagcacctgatcggcgggcgcgcggcccagcgtctccgcgatctccgcgaaaccgttcatgtcgatcaccagcacggccgaccaggtgccggtccgcgcggcgtggagcaggctccggtgggacacggcgtcgaaccggtcccggttggccagcccggtcagtgcgtcggtcagcgccgccgcctgccgcctgcgccacaggagtgtcagcgcgccggacgccgggcccagcgccgacaggccccacaggtaccaggtgtgcaaggggcctcctccgccgcgccgacctggctttgatcggacaccgaccgggccacttgaggaacgcccgcggctcctaggatcggtggatgccagtcccgcagacgcacgacgaggcggtcgaggccgcccaccggctcgccgccgtcctcacccccggcgcgatcgggcgcgaccgcgacggagcgacggtgatcccgtccgaggcgctcgccgcgctcgactcctccggcctgctcgcgatcaccgttccggccgccgacggcggtcccggcctcggcccgcgcaccctcgccgaggtcgcccggatcatcgcggccgccgacccgtcgatcgcccaggttccgcaggcccactacctgatgatcgacgtcctcgccgtgcacggcaccccaccgacccgcaagcggttgtacgacgaagttctcgccggccgccggctcggcaacgcactcgccgagcgcggcggacagcacgcccaggatctgcggacgaggatcagcggcggccggctggacggcgtcaagtactacaccaccggcgccctgaccagcgcctggatcgcggtcagcgcgctggacgagcagggccggctggtgctcgcgttcgttgcccgcgacgccgagggcgtgaccgtcgacaccgactgggacatggtcggccagcgggccacgatcagcggcaccgccaccttcaccgaggtgatcgtcgagcccgggatgcggctcgactacgccggcgcctatcagcagccgcagcagctcggcgcccgcgcccagctctaccacgccgcgatcgaggtgggcatcgccggcgcggcgctcgccgacgcccgtgcctacctgcgcacgaaagcccgccccgccaccgaggcggtccgggcgggcgcgggcgtggcggccgacgacccgcacgtcaagcatcggtacggccgcctcgccagccgggtgcgggccgccgaggcgctgctcgacgcggccgcacgcacgctggaggcgatcaccctgaccccggcggacgccgacgccgcggcccggggctcgctcgcggtggcggccgcgaaggccttcggcagcgagatcgcggtcgaggccggctcggagctgttccagatgtgcgggacgagctcggcggccgcgaaatacgacctggaccggcactggcgcaacgcgcggacgcacagcgtccacgacccgctcgactggaagtaccaccacctcgccgcctacgacctgctggacgtgctgccgcccaaccacgggcagctgtagcgggcgggtcagccggtgtagcggaacgcggcgaagaccacgtcggcgctgtgctcgaagccgagccgcccgtacagccggatcgcgttctcgttgtcgtggaccgcgtgcaggaagggcagctcgccgcgggccaggatgccggccgccacggccagggtgaggcgcgcgcccaggccctggccgcggaactccggatcggtgcagaccgcggagacctcggtccagccgggcatccggatccgctcgccggccatcgagatcaggcggccgtcggcggaccggatgcccaggtagcggccgaggtcgacggtgcgcttgcggaacgggccgggctgggcgcgggccaccaggtcgagcatctcggggacgtcgtgctcggtgagcggcaccgcctccggatcgtcgacggcggtcatcgcggtgccgaccatctgcacgccggctgagcggccctcctcgacccagccgcggggcgggctgatcgccgggccggtgagcagtgcgtggtcggtgagggtggccaggtcacgccaggccttggggtcggccgggtcgctgacggcgcagaacggcgagatctcgggcaggtatcgggcggcgtctccggcggcctcggcgtagccggcctgtggcccggagagggcggcccacacggggttgttcagcacactgtgacattgcccgctgcgagccgcccgcgccagtggataaggggtacccctcctcggatgagtgagtgttcagtaaccgacagttgactggcgttacgccgtcatcgcgatcgcctccgccgcggcggtcagggccgggatcgcggtcggccacagcggcttggcgaagtggtagccctggccgtagtggcagcccatggcgtccagggcgaggtgctgcccgggctcctcgatgccctcggcgacgacagccaggtccaggttgccggccagggtaacgatcgcgtcgaccagggcgtgctgctgccggctggtcagaatgtcgtcgatgaacgacttgtccagcttcagcacgtccaccggcatctgccgcaagtagctgagcgacgaataccccgtaccgaagtcgtcgatcgcgacccggacccccatggcgcgcaacgcgcgcagatcctggaccaccttgtcggcgtcgcgcagcaccaggctctcggtgatctccagcagcagccactcgggccgcgcgccggccgcggcgagcgccgcgcgaacctggtcgacgaagtcggccgagcggaactggcgcggcgacacgttcacgctgacgtagcgcagcgtggtgtgcgggtcgtcggccttccagcgggcgatctggcacagcgcctcgcgcatcacccagttgccgatgccgacgatcgcgccgttctcctcggcggcctcgacgaagtggaacggcccgagcagcccgcgggtcgggtgctgccagcggaccagtgcctcgacgccggtgacccgctggtcggcgagctcgacgatcggctggaactgcagcatgaactgctcgtcctcgatcgcctcgtgcagttgggcgcgcatctccaggcgctgcaccatggcgtgcgccaggtcgctctggtagcgctgccagcccgccttgcccatccccttggccaggtagagcgccaggtcggcgtggcgcagcagctcggtggcgttgtccgcgtcgccgctggtcgcgacgccgacgctgacccggccgctgaccaggtgcaggccaccctcaccgtcgggcacctcgatcggcgcgtcgagtgcggcgacgagccgggccgccacgtcctcggcggcgtgcgcggtgtcgctctgctcaaccaggatggcgaactcgtcgccgcccatccgggccgcggtactgccggccccgatgatcgaggagatccgccgggccaccgcgatcagcagctggtcgccgatcgcgtgtccgagcgtgtcgttgacctccttgaagtcgtccaggtcgacgaagagcacgccgagcgtggcgccgtcccggctggccaccgtgaaggcctgttccagccggttgcggaacagcacccggttggccagcccggtcagcgagtcgtggaacgcctggtgggtcaggtcgtcctcgaggcggcgctgctcggtgacgtcgcgcagggtgaccaccaggccggcgaccgtcgggtcgtcgcgcaggtcgcgcaggtcgcactcgacggtcatccggcggccgccggcaccctgcgcggtcagctcgacgccgtccagatcgccgtgcccgcggcgcagccggcagagcacgtcgcgcagcgcctcctgcgcctccggcgcgatcaggtcggccagcggggtgccggccgggatgaccgtgccgaacagcttgtcggccgacgggctggcgtaccggacggtggtgtcctggtcgccgtcgacgatcaggatgacgtcgacggtccgctggaccagggtgcggaagtaggtctcgctctcccggcggccgacctccgcggtcagcgagatccggtccagcacgacggcgatctgcgcgcccagcgtctgcagcgcgggccgcagggtctgcagcacgtcctcggccgcgccgacgatcagctgcccgtgccactgccggccgggcagcggctgggtggcgaacaggaccgtcgggaagccgcccgcgtccaccccggcgggcaggtcggcggcggcccgccagtgcacggcgacgtcggccgggccgggggcctgcggcggcagctccaggtggtagggctggccgggcggcatcagccgggccaccgcctggtgcagcgccgcgaccacgtcgcgttcggtggcggccgcgaagagcagggcgccggcctcgcgcagcgcccgctcccgggccacggcctgccgctgcgccatcgccaggtccgcgagccggcccaggaccagcaggaacatcaccgccgcggcacccgcgatgaccggcgcgtcgacgatgccgtcgcgctggatctcggccgggcggccctgcagatactccaggcagagcaggatcggggcgatcagcgcggccgcggtcatccagaccaggcggtgccgcccgatgatcgagcggcaccgctcggccggttcggtgagctgccgcatcgacgggcgcagcgcggtgaagcccatcgccgagtagaacaggacccagcccaggtcgaccggcccgcccaggacccagtcgtcgcgcagctgggactgcccgtagaagatgtccgagaccagcaggccgagcatcgcgacgccgaggctgcccagggtgcggggacgggtgccggtctgggtcagcatccgcaggatcatcgcgaggaccagcacgtcgccgagcgggtagccgatcgagacgatcttctgcaacacggtcaggtcctgtgcccgggtgaacggggcgatccagtagacccaggccagcaggcccaggccgacggtcggaaccagggcgtccagcagggcgccgcggttgtcgccgcggcccgagcgggcccggatgaacagcaggagcgcgccggtcagcagcgggtagacgagcaggtagaacaggtcggccaggccggggaagccgggcctgccgccgagcgcgagcaccaggttgtaccagctgtccccggtggtgaagcaggcgagcgcggcactgacgagataccagggcaggcgccggccgggccggttcagtcgggtacccaccaggatcgccgccgccgacgagtagccgagtagcgcccaggtgtacaggtgggcggccgggaacgcgtagtagagcgcgaccagcaacagcgaccaggcggcgaagcatgcgcgagccgtccgcgtcgtcatgcgggctccgttcgggggaggggagaggtccgactttgccgctatcgggttcttcgacggggatctgaggggggcttgacgggtcgcacccggacggcaatcaatagacggatgtcgtttcttaacctttcggccacccgccgtgtcggaagtcgtcgatgatcttgaggaggatgcgggcatgtcccttcggcgcatcggggtcgcactggcgtccctgacacttctcggcaccggcgtcaccgccgcgtcgccgcaggcccaggcggccaccaccgtcccggccttcgaccacatcgtcctggtgatgttcgagaacaaggcgtcctcgcagatcacctcgtcatcggctgcgtacttcaccgccctggccggccagggcgcgaagttcacccagtcgtacgcgatcacccaccccagccagcccaactacatcgcgttgttctccggcgccacccagggcgtcaccaacgacaactgccccaagacgttcaccaccggcaacctcggcgcccagctgatcgcggccggccggacgttcaagggctactccgaggcgatgccgtcggacggctacaccggctgctccagcggcacctaccggcgcaagcacaacagctgggtcgacttcagcaccgtgccggccgccagcaacgtccggtactcgaccttcccgtccgactacacccaactgccgacggtctcgttcgtcaccccggacatgtgcaacgacatgcacgactgctcgatcagcaccggcaacacctggctcaggaacaacctcgacgggtacgcccagtgggccaagacccacaacagcctgctcatcgtgacgttcgacgaggacaactcgctctcgctgaaccacatctacaccgccttcgtcggcgcgaacgtgaaggtcggctcgtactccgagaagatcacccactacacggtgctgcgcaccatcgagtccgcgtacggcctgtccgccctgggcggcgcggccggcgtctcgccgatcaccgacgtctggcagtagtcccatgtatctggcctcggtggaacgtccggccgtgcgccggaccgaccgcacccagcgcctcgccggcacggttctggctctcggcacggtcagcctgatcaccgacgtgtccagcgagatggtctcggcgatcctgccgctgtacctgatcgccggactggggctcagtcccgccgtctacgggctgatcgacggcgtctacaccggggcgaccgcactgctgcgcctggccggcggctatgtcgccgaccgggcgcggcgccgcaagacggtcgccgcggtcggctacggcctctccgcggtgatgaagttcggcctgctcgcggccggcaccgcagtcccctggatcagcgccgcgatcgtcgccgaccgggccggcaagggcctgcgcaccgcgccccgggacgcgctgatcaccctggccacccccgctacctcgctggggcgcgcgttcggcgtccatcgcgcgatggacacggccggcgcgttcgccgggccgctggtcgcgctcgccgtactggccgcctccgggcaggcctacgactcggtcttcgtggtcagtggctgcatcgccatggtcggcgtgctcgtcctggtgctcttcgtccgtgatcaccgcggcccgcggccggccgcgaacaccgtcagcctgcccgctgcggccgcgctgctgcgccgcaaaccggtccggatgctgctgatcggcgcggtcctgctcgggctgagcaccatcggcgacggcttcgtctacctgctgctgcagcgccgggagagcctcgcgaccggatggttcccgctgctcgcggtcggcaccagcctgacctacctgctcctcgcggtgccgttcgggcggctcgccgaccgggtcgggcgggcgccggtcgtcctcggcggctacgccgccctcgtcgtcgtctacaccatgctcggctccgggctcggcggcccggtcaccatcgtcgcggtgcttgtgctgtacggcggttactacgccgccacggacggagtgctgatggccctcgccggtccactcctgccggccgagttgcgcaccaccgggctggccctggtgcagaccgggcaggcgctggcctacctggtctcctcggtgctgttcgggctggcctggcagtggtgggacgcgaccggggcgatccgcgccttcaccgtcctggccgtgctgaccctgtccgtctccgccgggctcctgctgaggtcgaaccgtgagcgctgaaccgtctctgcgccggcgggtgctgctcgccgccctggtctccgtggtcctgctcggcggggcggtggtgtacgtggtgatcgccgggcgccgtggttcggcgccggccgcggcggcggtggtcgacgcgggccccggcgaccgggtgctgttccgcagcacggcggcgtccgggtacgggcgggtggcgaccgtggcgcgtggcgccgagacggggcagcggacggtctccgggctcgactgtgaccgggtgtacgcggccgccgggcgcgggatctgcctgcgaccggacgggccgctcgccacctaccagttggcggtgctcgacgccgggctgcgggtgtcggacacctacccgctggtcggggtgccgaaccgggcgcgcgtgtcgcccagcggcaacgtcctggcatggacggtgttcgtgaccggcgactcgtacaacggcgggaggttctccacccgggccggcatgctgaacctggccaccggcgacacggtggactcggtggagttgttctcggtggtccgcgacggccggccctaccgggcggccgacgtcaatgtctggggtgtcaccttcgccgacgaccagcacttctacgccaccctgtcgaccgccgggaaacgctatctggtcgccggcgacgtgaccgcgcagaccgtgcggaccctcgccgagaacgtggagtgcccgtcgctgtcacccgatcggacccggatcgccttcaaggaggcgatcaagggggatccctcgaaggggtggcggctgaccgtcctggatctggcgacgatgcggcggacgccgctggccgagacgcgcagcgtggacgaccagacggcctggtacgacaacaccacggtgatgtacgcggtgcggcgcggcagccggaactccgacgtgtgggccgccccggccgacggcggcggaacggcgcgactgctcatcccggacgccgagtcacccgcggcgctgtggaattgagccgttgttttgtacggtataccgccatggagtccgatcgacaggtgatgacggcgggcgcgcggctggcgctggcccggtgggagcggcggctcggcgtgccggagtccccggagccgggattggtggcgctgctcgaccggcacgccgcgcggatccgggactcggtgtcggggatgaccgtggcgaacctggccgcgtatgccgacggcgtcgccgacaccgcggcggcccgggggtggacacacccggacgcgggggccgactggcgggcggcgagctggccgtcgctgcacctgctcgcggtctgcctgctggcccgcagcctgccctgaccacggtgtcgcccccggtcgcacgcgcggccgggggcgacgtcaggtcgtcgtggggtcagccgaggcgacgacggcgctcgtcgccgggcagctcggcctcgatctgctccttgcggacctcgccgctgacggtccgctcgtcggtgaccgtctccttgcccaggcgcacccgctccaccggcaccgtctcggtctgcaccaccggccgctcctcgtgcagggtgacctcgtgctccgactcggtcaggtccgggccgctgaaggcggcgtcccggttcgcgtcggtgaccggctcacgctccagccgcacctcctcgcgggtgaccggcacgctgacctgctgctgctcggtcgtcacgtacttgcggagccgggccttgccggtccgctcacgctcggtgccgacggtcagccgctcctccgagcgggtcatcgcgtcgtcgccgcgcaggtggccgtcgccctggccggcgccgagctcgtagtcggtgccgccggggcggctctggccggtgtagttctcgtcggtgtagctatcgccggtgtagttctcgttcgtggcggtcgccccggcctggtacgaccggtagctgtcgtgctggttcacgccgtagtaggagtagagctggtcgacctcggcctgggtcagcggctcgtcgtgcgaggcgtccacgttcggcgcgtccttgaccgtcgccttgtcgaacggcaccaccagccggtcgtcgcgcaggtccgcgtcctgcagcgggaccagcgactcgttcagtccgaacaggccggtgcggacactgacccaggtgggcagaccggcggcgtcggtccacacctgcccggcggtgccgatcttgtcgccgtcccggtcgtggacgtcgcggccgctcagcgtgtgaatgtgctcctgcgtgatcacggggggtctcctatcgtccggtatgtagcgatgtattcagttttgagctctcgggttagttgtgcccacggctgccggcttctaacaacccacttccactcattcacgccccgttcgtgtcagcggcgggatcggggtcgccggcgtttgggtgccccgggcggcgggcactgcacccgcatgtttgcggcggagaatctgcgtgactggcgtggccagaatgtgatcgaccgggacggcgacaagatcggagagttggaggcggtctacgtcgacacggcgaccgacgaaccctcattcgtcacggtgcgcaccggcttcatcgggcggcaccgcctgaccttcgtcccgctcggcggggccaccgtcaaaccggacgccgttcgggtgcaggtgaccaagaagcagaccggcgacgccccgtcgatcgatgtcgacggtgagctgctcgccgctgacgagccgggcgtcttcgcccattacggtctcccgtacgcggcgggtgccggcggcgagcgtcgcctcgcccgccgctgaacagccccacccgccgcggaatcaaccgcggcgggcatcttgcccgtcgtggaatcaactgcggcgggcatctcgcccgtcgcagcatcaacccgggtgggcgcctcgtccgtggctgaaccagccctcggtgggcgccccgccgtcgctgaaccagccctggcggcccccggcccgcctgctgggcgcggtctcggatgcctccggcccgccggctgggcgcggtctcggatgcctccggcccgccggctgggcgcggcctcgaatgcccccggcccgcccactgggcgcggcctcgaatgccccggtcaggccggcctgcgcgggatcggctcgcggccgccccggagctcgaccaccgtgccgctcgcgccgccggcgatcaggtccaggacggcatcgaccacctgagccggcgggatcagcggtggcgtgaccgcccgctcggccgggctcagcgcggcgaactccgcgtgcgcccggtccaggccgatccaatccggcacgatacaggtcacccgcaccccgtcgagcccggccaggctggtcgtcagccggaccaggccggccttggccgccgcatactccggtgacccgtaggcgccgtccccgcgcgccgcactggacgcgacgttgaccaccaccccgccgccgagccggcgcatcggctcccggacgagctgggtgagcagcatcggcgcggtcaggttcagcgcgagggtggccgcccagtccgccggctccgcgtccggatactgccgcccgccacgcgtccacccgcccgcgttgttcaccagcacgtgcggaccgcccagctcggccgcgacccgcaccacacctctcgcctgctccgcatcggtcacatcagcgcagaccgcgaccgccaccccgccggccaccgccggtgaatccgctcccgctgccgcatccgcgcccaccgataaacccgcagccgcatccgcgcccgccggtggacccgcacccgcagccgcacccgcgacctgctcggcgcgggccgcgctcgcctcggcagccgcaccgtcgacatccgcgacgaccacggtgaaaccggccccggccaggcccacggtcagctctcggccgaggcccgcgccacccccggtcacgatcgcgacgcgccgcggcgagccgatccgcgggagaatctcgccggccatcggatctcagcccgccagagcgtccaccaggcggcgcgccgagccggccagattccaccgctcggcgagggcgagcagcgcctgcgggtcgcgaggctcgcgcggcagtgccggatccacgtcgggcagcttgacgtcgagcgccacccggcagaccggcagagccttcgccaggtagtcccggccggcggcgagcttcgtgcggacgccgggggcgaagcccgcctccggatcgtcgagggcggccaggatctcggcgatcccgccgtagcgctcgatcagccgggcggccgtcttctccccgacgcccgcgacgccgggcagcccgtcgctcgggtcgccgcgcatcgccgcgaagtccgcgtaataccgcgccggcaccccgtatttcccctggaccagagcctcgtcggcgtcctccagcttggccacgccgcgcccgcagtagagcagccgggtgccccgcgcgtcgtcgaccagctggaacaggtcgcggtcgccggagaccacctcgaccggggcggcctgggtcgcggcgatggtgccgagcacgtcgtcggcctcgtagcccggcacgccgaaggccgggatgccgaccgcctcgagcacctccagcagcaccggcacctggcgctccagtgcggccggcacctcctcgacggtgtcgtgggcgacccggtgcgccttgtaggacgggaccagctcgacccgccaggccggccgccagtccgcgtcgagggcgcagatcagccgatccggccgccgggtgcggaccagctgggcgatcatgtcgaggaagccgcggatcgcgttgaccggctcgccggcgtcggtctgcgccgccttctccgggatgccgtggaacgcccggaaatagaggctgggggcgtcgacggccagcagtggtcgggtcacgcgcctaccctgccacacccctccgacattttcggcgaccgcgagacggcgtcccggctgtcccggaacttgaacgagcgttaagctcagggggtgaccgtggatcgactgcttcccacccctgaggcacacgacctgctcgacctgacccgtgagctcgccacccgtgagctggccggcaaggtcgacgactacgaggcgcgcggcgagttcccccgggagatcctgcgtacgttagggcgttccggcctgctcggcctgccttatgccgaaagcgacggcggcgccggccagccgtacgaggtctatctccaggttctggagatcctggccggcacctggctggggatcgccgaggcggtcagcgtgcacacgctgtcgtgcttcccggtggcggccttcggcagcgagcggcagcgcaaggcgctgcccgagatgctcggcggcgagctgctcggcgcctactgcctgtccgagccgcagggtggctcggatgccggcaacctcgccacccgggccgtgccggacggcgaggactggctggtcaacggcaccaaggcgtggatcacgcacggcggccgcgcggatttctacaacctgttcgtccgcaccggcggccccggccccaagggcatctcctgcctgctcgccgacgccgccacgccgggcctgctgccgcaggcgccggagcggctgatgggcctgcgctcgtcggctccggcccagatcgtgctggacgacgcgcggatcccacacgaccggctggtgggggagcaggggcaggggttcgcgatcgcgatgcaggcgctcgacgcggggcggctcgggatcgcggcgtgcgccgtcgggctggcccaggcggccaccgactacgcggtcgcctacgcacgggagcgggagcagttcgggcagccgatcggccggttccagggggtcgggttcatgctggccgacatggccacccaggtgtccgcggcgcgctcgttgctgctggccgcggcccggttgaaggacgccggccggccgttctcggtcgaggcggccaaggcgaagctgttcgccaccgacgcggcgatgcgggtgaccaccgacgcggtgcagatcctcggcggctacggctatgtggccgatcatccggccgagcgctggttccgtgaggcgaaggtgttgcagatcgtggagggcaccaaccagatccagcggatggtgatcgcccgctcgctgaccggctgagccgcgccggcgacccggtcgttactcttaccggcgtggaagagatcgaccgggcgatcgtgtcagccctcaccgtggacggacggctgacctataccgatctggccgagcgggtgggcctcagtgtctccgccgtgcaccagcgggtgcgccggctggaggagcgcggggcgatcgccggttacacggcgaaggtgtcgttcgaggcgctcgacctgccgttgaccgccttcgtggcgatccgcccgttcgatccgtcgcagccggacgacgcgccggagcggctggcccacctctccgagatcgactcctgctactcggtggccggtgaggacttctacatgctgctggtccgggtgaagagcccggccgacctggagcggctgctgcaggacatccgcacggcggcgaatgtgacgacccggaccacggtggtgctgtccactccttacgagaaccggccacccaggatcgcccccgaataggctgttgcctggtttcctaggacgcgtcaggggatgtgtcggatgaacgccgacgacgtcgacgcggcagttcaagagctgcaggacacgcttgcgccgtacgcctacggccccgcctggtccacccgggccggcgacctcgactggacctgccggcaaaccgccgtgcacatcgcgcacgacctcgtggcgtacgccgcccagctggccggccgggccgacaatgggtatctcccgctggatctgcgggtcgacccgggcgcgacgccgggcgaggtcctgcgggtgatcgcggccgcggccggactgctcagcgcccagctgcgcgcggcgtcgccggacgaccgggcctggcactgggggccggccgacccgtcgggattcgccgcgctcggcgtcaacgagatcctgatccacacgtacgacgtggccggcggtctgggtgttgcctggcggccgccggcggcgctctgcgcggcggtgctgagtcggctctttcccgggcatccggacggcgacccggtggccgccctgctctggtgcaccgggcggatcgcgctgcccggccgcccccggcgcacctcgtgggtgttgcgggccgccgtggattgaccggacccgtgtcggctcgggccggagcgcgttgtcccgcagggacatcaggcgtccggcacgggcatcagcctgtccggcacgagcggaggcggacggaccatgcggcgacgaactctgctggccgccggcggcgccggcgtggcgaccgccgtggccggcgggctgtgggcccgcggatccgcgccggccacggtgcccgcggtgcccgtgccgtcggtgccgcccggtccggaacgctgcgagctccggtactcgaaggcccgcgggacgaccgtcgacttctacaccgcggtgccggccgggcacggggacggcaccgggctgccggtctgcctcgtgctgcacggcggatcgaagcggcccgccgacttcgaggcactcgggctcggacactttctgaccgacgcggtggctcacggcgcgccgccgttcgtgctggccggcgccaccggcgaccgtctcgcctggcagcccgacgggcgcgacgacccgcagcggatggtgcacgaggaagtgccggcctggtgcgcggcacgtggcttcgacaccagccggctggtcgcctggggctggtcgatgggcgggtacggctcgctgctgctggccgagaccttccccgggttcgtccgcgcggtggccgcgttctccccggcggtggtgcccggggacgtggtgttccagaacgcggaccggctcggcgcgacgccggtgggattgtggtgcggcagccgggatccgctgtacggcagcgtgcgggcgttgctagctagctagctcgccgcgcggtcgcaggcgatcgccgatctgctgaatctggcgcagcgggcgaagcaggccgccgacgcgcagaagaagatcatcgaggcgagtgtggcggcgacgtcgttgctgaccgtggccggcaacgcgatgggtctgtccaaccggggcgccaagcaggccgacaccgtgtacgccgcggatctgccgctgcggaaggcgaacaagccgacgcacaccgccgacctgtccgctctgcgggtgcaggtgtgccaggacgcgtcggtggccgcgcgcaacgccgatcaggtgaccgcgcaggccggggtggcggctaccgcggcggccacgctggagaagaccggcctgacccacggcatcgcctggtccgaggtgacccaggcgcagggtgacgccggagcggcggcgaagctggccgcggagacggcgtgtcatgcggccgaggcgacggaggcggccggcaaggctctggacgccgaccacagcgcgaccgtcgacgcgaacaacgcggtgaagtaccggcaggccgcggagcgcgagcaggccgccgcggagaagctggcggacaaggcggagaagctggcggctgccgcgctggcggcggcggccgacgcgaaggcgcagcggttgcgggccgagaaggatgcggccagcgcccgccagcacgccgccaacgcggccggctactacgcggacgcgaagcggcagcgggggatcgcccgggaggcgaccgcggcggcgatccagcactcgctgaacgcctactcggcggcgcagcgggcgatcgcgcagcagaacgtggtggtggccaagggcgccgaggccaagcagaagcaggatgaggcgctcgctagctagctagcggcgcagcaggcggcgaacaacgccgccggtttcgcgaagaaggcggatcaggcggcggacaacgcggaagcgctgtcgaagaagatcaagcaggtcagcgacacgatcacgtcgatctccgacggcatgtgggcggtcgcgcagaacatgggccggatggccaagaccctgcaggacatcgcctggcaggcgtacaacgccgagcaggcggcggcggagaagaagctcaacgactggatcgacgacaaggcgaagtggctcaacgaccacatcggcgggtcggacgtcacgaagggcttcatcgacggcgcggccggcatggtcaaggggatcatccagaccagcaactgcgtgaccggcacgttcctgggcaccgacgcggccaccgacgagtacacggtgcccgaggtcagctacctgccgaactcggacaagtcctgcaacatgctggtcaagggcttcaaggacctactgagcgacccgaagcagctgctgcactgggacgactggaagaagaactggaagtacgcgctgggcgagaccctgttcgacggggccttcttcctggtcaccgacggcaccgggctgatcaccaagatcgctgagagcggcgtggcgcagaccgccaagcaggcgatcagggacatcgccaagctgtcggccaaggacatggcggccctagctagctagggggtcgtcaagttcggcaccgagaagctggtcaacgcgatcaaggaactcggcgcggtcaccacctcccggatcatcgagctgaccaccgcggtgggtggcaagctggcggtcaccttcagtgccgacgaattgaaggcgctgtccaaggcgatcggtctcaagggcatcgacgcggtggagaacgcgctgcgtggcctgaaggatctgccggtcctcaaggggctcaccgatctcctggagagctgtttcaagcgcaacagtttcgccccggacacccgggtcctgctcggcgacggcaccagccgggcgatcgccgacatccgggtgggcgaccgggtgctggccaccgacccgatcaccggggtcacccggccggagccggtcaccgcgctgcaccgcaacgacgacaccgcgctcgccgacgtcacggtcgaggaccgggccggccggcagagcacgctgcacaccacgcgggaacacccgttctggaatgccggcacccggcagtggacctacgcgggtgacctgcggccgggcaccgcgctggccaccgtcggcgcgggccggtgggcgggcgtcgcccgggtgcgcacgttcaccggcgagcggacgatgcacaacctgacggtcgccgacctgcacacgttctacgtgctcgccggccggacgccggtgctggtgcacaactgcaacgtcgcgctcggtcagaagatggccggcacctacaagtgggcgaaggacaacaacttcgagcacttcggcgacctgggcccggacgagtggatgggcccggtcaaggacgcgatccggaattccaacgtgaccctgcacgtcaacatggaggagatgggtagcttcgtcgaatcggtgcgggtcggcatggagggcgtcggtggcgccacggacctggagatgagctggatcgcgacggcgatcatccggggtgagcggacctggtcgtcggtgaacttctacaagctggtcaacggcaagatgacgaagatcgtcgtcgaggagccggactggtcgaagatcaccccgcagcgctggttcaccgatccgccgacgagctgcaaatgtctgtgaggtgggctcccatgagtgaccggatggccgagctgtatcccgaggtggtccgcgccggcgggctcgccgaggcgctgcgccgggccgcggcggcccgggacgtggatctgggcccggccctggagcagtcgtcggcccgctggtcggcgagcatcgacgcgccgcacgggggctgcgaggtgagcgtcggcgccgagcaacggttcttccacgtggagatccggcggtcggactatcgggccacctgggtcagcggcgccgcaccggagctcgatcccgtcgccggggtgatcctggcctggctggcgggggagagcgcggcggcggtgagcgcccggttcccgttcgtcaccgcgggcgagttcgccgacgtcgcgggcgacgacgagatggtcgccgcgcagtggcggtcgctgctggccgccccggagtaccgcgacgaacggccgcttctcgcggcggtccaccgttcgccgcgggctcgccggctgtttccggtgctgacccacggcatgctgcggctgagcgcggacatgggccgggtcggcggccgggagatccggatcgtgccgctgcggcacggcggtcaccggatcgaggacggtgcgggcaccgtgctggccaccctggagtcgctgctcagtctggatccgctgctcgacctggactcctgagcgaggagcgggaagtggtgatggccgggcgcgacgcgcccggccatcaccggtgcggcgtcaggcgggcaggtcggcgtaggcgcactgggtgacgtacgggaacgcgtacgagtcgcgacccagcagcgccggatgggtggcggtgagctggcggacctgggccagcacggcggcccgctcgtcggccggcagcaggatctgacggctccgggaggcgaccaggtccagcagctcgccggcccgcaccgggtgcgtccagccgaaggtggcggtggtgaccgggccgaacggcggacccatggtcgtgccgcggggcgcctcatggccgatgatcgtgccgagccggtgcacccagtcggtgcgttcgtcgcgcaggttccagatcaggccgaggcggccgcccggggtcagcacccgggcgatctcggggacggcgcgggccgggtcgatccagtgccaggcctgggcgaccaggaccacgtcgaccgaagcgtccggcaacgggatccgctcggcggtgcccgggtgggccgggacgtcgggcacggtgcggcgcagctcggccagcatgccctcggacgggtcgacggcgaccacgtccaggccgcgggccaggatctgccgggtcagcttgccggtgccggcgccgaggtccagaacgcgcgcgcggcccccggggagcaggtagtcgagcgcgggctcggggtacggcggccggccacgctcgtaggtgccggcggccgacccgaaggaggtggcttcgtgatccacgagcgcgatcatatttcgcgttcctgagcgcggcgcagacggcgggtgcgactctcccgggtcggtttcgggatcggccggttcggggaaatacaagatcagaggcaccccgagacgacacgaccccgggagggttgactgatgagcttcaccgacaaggtcaagaacaagaccgaggaactgaccggtaaggcgaagcagggcctcggcgaggcgaccgacaaccagcgcctgtacgccgagggcgaggcccaggaggccgccgcgcacgccaagcaggccggcgagcacgtgaaggacgccggtcgcgacgtgcgcgacgcgctcagctgagccgcgtcgtcaccgcagcgaagtgcgggcctcccggatccgatccgggaggcccgcacttttgtccctaggcgccggcgagggactgcttgcgccaccagtcctggccgctctccggcagcgtgtcgatcgggtcgtagtaggcgtacagcttgctcaacgcctcgctgtcgtccttctcgatcgacgtacggtagttcttggtccagtacgagatgccgtgctcgcggtcgtactcggcgaccatgtgcacccagcgcttgccgacgaacggcacgtcgcagacgatccgcggggtggcgtaaccgggcaggtagcccatcaggtcgtgctgcagctgctgggcgtgccagaccgggacccgccagtgctccgcgttcgggatcatgtcgcacatgtagaagtagtacggcaggatcccggcctcgccctgcagcgcgaagcacaggtcgagcaggtcgccggcggtggcgttgacgccgcgcatcagcacgccctggttgcgcacgtcgcggacgccgacctcgagcagggtgcggaccgcgcgggcgaccgtcggggtcagcgagttcacgtggttgacgtgggtgtgcacggccaggttgacgccgcgccgctcggcggtcacggcgacccggtgcatgccctccaccacgtcgtcctgcagccagtgctggggcagccccatcagcgccttggtggccagccggatgtcccggacggtcggcaccgccagcaggcccatcaggtaggcctccagctgcttccacggcacgttcgccacgtcgccgccggagaccacgacgtcccggacgcccgggtgggccttgaggtagtccaggtgggccgcgtaccggtcgaccggtttctgcaccagcttcagcttggcgaccgccggcgtgctgttgccgaccaggtccatccgggtgcagtgcccgcagtactgcgggcaggtggagagcagctcggcgagcaccttggtcgggtagcggtgggtcaggccctcggcgacccacatgtcgtgctcgtgcagcgagtcacggctggcgttcgggtgcgacggccagtcccggcgccggtccgaggcgaccggcagcatgtagaggcgcaccgggtcggcgtagaacgacgcggtgtccggcacctggtgcggcaccatcgtgttgaccatctgcggcgggagcagcatcgacatggtcgccagctcggcctggtccttctccaggtcggcgtagaacgactcgtcgaccaggtcaccgaggacggtgcgcagctgcttgacgttcttcacacagttgacccgctgccactgggcggactgccactgggcggcggtgacgtcccgccaaccggggaaccgggtccaatccggctcgaccagctcacgccgctggtactcgtaaggctgtccgctgtcgagctcggcaaccaccgcgaccccttccttaagatctgatcaggtgcactaacgtactggagaatcttcggtctagaaacccggggcacgaaagatttacggtagtggggccgctaggggccagtgtttagtgtgagggggctgttgatggcgggatcggtgggtctgggccgggtgctcgagccgagtggcgtgttgccgcaggccgcgtggcggctggacgccagcccggagatcgggccggacgaggcgcgcatccgggtgcagcggctcaacctcgacgccgccagttatcggcagctcggggagaaacatgcgggggacggcgcggcgatccgcgccgaggtgctggagatcgtcggcacgcgcggcaagatgcacaacccggtgaccggctccggtggcatgctgatcggcgtggtcgaggaggtcgggccggagtcgccgctgccgatcaagccgggcgaccgggtggcgacgctggtctcgctgaccctcaccccgctgcggatcaccgacgggctggccggctgggacgggctgtccgagcaggtgccggcggacggcacggcgatcctgttcggccgctcgatcgtcggcgtgctgcccgacgacctgccgccggagctggcgctcgcggtctacgacgtgtgcggggcgcccgcgctcaccgaccggatcgtccggaagtatcaggacccgaccgtgctggtgctcggcggggccggcaagagtggatcgctgagtctggccgcggcgaaacgggccggtgcccgtaccaccgcgatcgtcgtctcggaggcggagcgggccgcgctcagcgaagcgggcgtggccgacgagatcgcgatcgccgatgcccgcaatccggtgcaggtcgccgagaaggcgaccgccgacatcaccgtggtctgtgtcgacgtgccgggctgcgagcacggcgcgatcctggccaccaagcccggcggcacggtgatcttcttctcgatggcgaccagtttcgccgcggccgcgctcggtgccgaggggctggccgccgacgtgaccatgctggtcggcaacgggtacgtgccggggcacgccgacttcgcggtcgacctgctgcgcaccacccacgcggtccgtggcttgttcgagaagcggatagcgggagactgatccgcatgacgcttccctcggtccgctacaccaacggtcgtttctactccgccgccgagccgcgcgccaccgcgatgctggtccgcggcggcaccatcgcgtggctgggcgacaccgccgacgcgccggccgccgaccgcaccgtcgacctggacggtgcgctggtcaccccggcgttcgtcgacgcgcacctgcacgtcaccgacaccggcctggccgccgacggactggagctgtccggcgtccgctcggcgggcgagctgctggcggcggtggagcggttcgcccggaccaggccggccggcgcggtggtgcacgggcagggctgggacgagtcgacctggaccgagcagcggctgccgaccgcggctgagctggaccgcgccgccgccggccgccgggtctacctgacccaggcgtcggtgcactcggcgctggtcagcgcggcgctgctgccggccgccgagggggtcgacggctacgacccgtccgggtgggtgcgcgagcacgcgcaccacgcggtgcgggcggtcgcgctcggctcgctgtcgccggagcagcggaccgacgcgcagcggaccgcgttgcgcacggccgccgccgccgggatcgccgcggtgcacgagtgcggcggtccggggacctccagcgaggccgacttccagtcggtgctgcgcctctccgggcagaaccttcccgaggtgtacgggttctggggcgagctgggcggcgccgacaaggcgcgtgagctgggcgcccacggcgcggccggcgacctgtacgcggacggggcgctcggctcgcgcaccgcctcgctgcgcaccccgtatcgcgacggcgaccacggttgcggcgaggcgttcctgaccgccgagcaggtcgccgagcacctgctcgactgcatccgggtcggcttccagggcggcttccacgcgatcggcgacgccgcgatcgcgaccgtgctggagggcttcgcgctcgccgccaagcaggtcggcgtcgaccggatccgggagggcaaccaccggatcgagcacgtcgagctgatcgacaaggcgatgatcgcccggatggtcgaattcggggtgaccgcctcggtgcagccggtcttcgacgcgctctggggcggcgccgaccggatgtacgcgcagcgcctcggcgccgaccgcgccctggccagcaacccgatcggggcgatgcacgccaccggggtggcgctcgccttcggctcggactcgccggtcaccgcgctcgacccgtggtcgaccgtggtcgcggcgatcgcgccgcgcaacccggtctaccggatgaaggttcgggccgcgttcgccgccgccagccgcggcgggtggcgggccgccgggatcagcggcgccggcgtgctcgcgcccggcgcctccgccaccttcgccgcctgggacaccccgggcggcctgcacgagggactgccggccctgctgccggatgtcgacggggccgtccccgcacggccggtctgccggcgcaccgtgctgcacggcgacacgattcacgagatttaggagcgaaacacttggccgggaagctggatctggacccgcggatcgtcgcgcgggcgcgggcgctcgccgccaaggccgggcagcccgtcgtcgacctcgcgcggtcgcacaccaccgtgtcggtggagcgggcagtgctgcgcctggccggcgtgcacggtgccgactcggacgggatcccctgggtgaaccgcctggtcgacgccgtgcgcgcggatgtcgggctgggccacggggtggccgtgccggtctgccacgcggcgctgaccacgggcgtggacgacctcaccgtgctcgcccagaaggcggccgcgggcgcggtgcggttcggcgtaccggagaagaagccggagatcgccgccgcccggcggctggcgaagaaggccgccgccaacggtctcaagatcgtcgatcgccggcgcgccgagcgcgacagactcatcaagcggtacggggatccgcagcagcggccgtggatctacctgatcgtcgccaccggcgacatctacgaggacatcccgcaggcgcaggcggcggcgcgggccggggccgacatcatcgcggtgatccggtcgaccgggcagtcgctgctggactacgtgccggagggggcgacccgggaagggttcgcggggacgtacgcgacgcaggagaacttccggctgatgcgggcggcgctcgacgagacctcgcgcgagctcggccgatacatccggctgaccaactacgcgtccgggttgtgcatgccggagatcgcggcgctggccgggatggaacgcctggacatgatgctgaacgactcgatgtacggcatcctgttccgcgacatcaacccgatccggaccttcgtcgaccagcggttctcgcggcaggtgcacgcccgcgccgggatcatcatcaacaccggtgaggacaactacctgaccaccgcggacgccgtcgaggccgcccacacggtcacggtgtcccagctgctcaacgagttcttcgcccacgaggcggggctggcggactggcagctcggcctggggcacgccttcgagatcaatccggatctgccggactcgttccggctggagctggcgcacgccctgctcgcgcgggagctgttccccgaggcgccgctgaagtggatgccacctaccaagcacatgaccggtgacgtgttccgcggcaacctcctcgacggcttcttcaacctcgccggcgcgctgaccggccagggcatcctgctcgtcggcatgatgaccgaggcggtcgtgaccccctggctgtccgatcgggacatcgcgctgcagaacgtgaaatatgtgctcaacggcgccggtaacctgcacgaggacttcacccccggcccgttcatccgcggccgcgccaaccaggtcctcggcgaggccatcgacctgctcgaacgcatcgtcgacgacaccctgatggatgccatcgcggacggcaccttcggcctgatgaagcgcccggccgaccgcggcaagggcctggacggcgtcgcgaagcaggaagccgactactacaacccggtcgaggagatgctgtgatcatccgcccctacggcgacaccacgggcgacggcatggtgcagctctccttcaccctgccgatcccgcacgacaaacgtgccgagggcgccgccctgcagctggccggcaagatgggcatggacccggcgatgctggtgcacgccaagcagatgggcggcggcttcaccttcttcgtcgtctacggcaaggtcacccacctggtcgacaccgagcaggtgcaggtcgtggaacgcgacttcccgctgctgtccgccaaagaggtcaacgcggtgatcaagcggaggttgcggcgccggctcaacgtggtcggcgcctgcatcggcaccgacgcgcacaccgtcggcatcgacgccatcctcaacctcaagggcatcgccggcgagaagggcctggaatattattccgagctgtcggtgaccaacatgggcgcccaggtgtcggtgcccgacctggtggagaccgcccgcgcgcagaaggccgacgcggtcctggtctcccaggtggtcacccagcgcgacgcgcacctgcagaacaccaaggccatgtcggccgccttccgggaggcgctgccggccggcaaacgtccgctgctgatcgtcggcggcccccgcttcgacgagctgatgaccgaggaactgggcgtcgaccggatcttcggccgcggcaccaccccccgcgaagtggcctcctacctcgtccacgccctgattgagagcagaaattgatcaccgtcacgcaccgccgctacgtcccctactcgcacgcgcactacgccgggaacctggtcgacggggcgtattcgctcgggctcttcggcgacgtcgccaccgaggtgtgcatccagctcgacggcgacgaggggctgttcgcctcctacgacgacgtgcagttcaccgccccggtgcaggccggtgacgtcctggagatcaccgcgacggtggtgcacatgggcacgcgcagccgccggatcgagttccggtcggtggtcgtctgccgggggaccggtggatccggcgcgcaggtgctcgccgaaccgatcgtcgcggtcacggcgaccggcaccgtcgtcgtgccgcccaaggcgtgaactctgcggtctgcgtcgacgtcggatcgacgtacaccaaatccgccaagatcgacctgagcggcgcggaactgatcagccgggccgaggtgccgacgacgtccggaacggacgtcctggagggtctgaccgccgcggtcgccgcggtcgacggtgcgggcgcgccgctctacgtctgctcgtcggccggcggcgggctgcggctcgccgtcgtcggctacgagagcctggtcaccgcggaggccgggcaccgggtcgggctgtcggccggcgcccaggtggtgcacgtcgcggccggtccgctcaccggtgcggcggtggccgcgctgcgcgcggcccgccccgacgtggtgctgctcgtcggcggcaccgacggcggcgacggcgaggtgctgctgcacaacgcccggcgcctggccgccaaccggttgcggattccggtggtcctggccggcaatgtcgaggtacgtgcggaagccgcccggttgttgcgcgagcgcggcgtgccggtgaccgagaccggcaacgtgctgccgcgcatcggcgtgctcgacccgctgcccgcccgggcggcgatccgggcggtgttcctgcggcacgtgatcggcggcaaacggctgtcccgaggcaaccgtttcgcgtcgatggtccggtacgcgaccccggacgcggtgctcgccggggtcgaactgctcgccgaccgggccgccgggggcgtcctggtcgtcgacgtgggcggcgccaccaccgacgtgtactcggcgctcgtgcccgacgcggaactggagaccgggccgcggcgcgacgtggccggaaccctgtggcgggcccgcaccgtggagggcgacctgggggtggcggtcggcgccgcgggaacccgggaagccgcggtcgccgagaaactgccggaaccggccggggaccgggaactggccgccaccgcggcccggatcgcgttgcggcggcacgcccgggggcactcggcggggccgggacagccgcgcaccgggggccgcgacctgcgggacgtgcggctggtcgtcggctccgggggagtgctccggcacgggggtggtgatcacgtgctggatgccgtgctgcacgatacggccgggggatgggcgctgccggaccgggcgcggacggtgatcgacaaggagtacgtgctggccgccgccggactgctggccacggaccatccggccgtctccggggcactgctgcagacactgctgtgacgtggatcatgacacgccgggaaacacgacacgccggaatggggaccagccggttgacagacctcccccgtccggacgtaccgtcttcaggtcctgtttcacggtaggcgactgtgatccgcttcgttccctaacccactggccgcagtgcagtcctcgcaggggtcgcgcgttcagccaggtccagggggtcggggtgcgcgggcggcgcggaccgggtcgcgaccgggagccgagacgagccgagcctggccagtagacaacggcacgacacgggcagccagcccgcggcgagtcggtccgaaggtcagcgggaggtccgcctcgtgccccggacgtgagagggacaggagacaccccgaggggcacggccgtaggacgccgtgcccctccgccagctttcggtcagcttttcggtacggtcttgcgacttgccgcccgaccggaaaacagcgaaccggcaggtagcctgcctggcgtggaaatgacgatgccgccgcccgaactcgccgctcccgagcccggcgacgcgcgcccggccggcgcgcccgccccgctctagctagctaggaggcgctgcgggaccgggccccgttcggcggcttcccgtggggccggctcgctttcagccagggcgacgcgcccacgctgcgcctggccgcctggggtggcgccccgctggtcaccttcgccgtcgcggccgccggcggcgccctggtcgcgctcgcctggcgccgctggaccgcggccaccctgctgcccgccgccggcttcgccgccgccctcgggctgctgatcggcggccccgccgcgatcccgctgaccgcccccgccggagcgacccgcaccatcgccatcgtgcagggcaacgtgccgcgcctgggcctcgacttcaacgcccagcgccgcgccgtgctcgacaaccacgtcaccgcgacccggcagctggccgccggcgtcgccgccggccgccagccgcagcccgacctggtggtctggccggagaacgccagcgacatcgacccgctgcgcaacaccgacgcgtccgccgagatctccgcggccgccaccgcgatcaaggcgccgatcctggtcggcgcggtgctgcgcaccgacaagccggccgatatcaagaacgccggcctgctctggctgccggacaccgggcccgacctggcgcagacctatgtcaaacagcacccggtcccgttcgccgagtacatgccgctgcgctccgtcgcccggctggtcaccgaccgggtcgacatggtcaagaacatgctcgccggcgaccactccggggtggtccgcaccggctcgctgaccctcggcgacgtgatctgcttcgaggtcgcctacgacggcatcgtccgggacaccgtcaccggcggcgcccagatcctcgccgtgcagaccaacaacgccaccttcgacgtgggcgaggcccggcagcagctcgccatggtccggctgcgcgccgtcgagcacgggatggactcgctgatggtctccaccgtcggggtgtccgccttcgtcgatacccggggtgacgtgcacggcgcgacgggtttcaacaccgcgaaagtggtggtgcataaaatgtccctcggggctacgcgtacgctggcgactcgttcgggcatctggcccgaggcgatcgcggtcgggctggccgtcatcgcactggccggcgccgcgcccctgcgccgtcggcggccggtccccagcacagacgacgacatgagcgtggaggaacgttgaccgaggtggaaggctacccgggagtgggccgggtcctcgtgatcatccccacgtacaacgaggccgacaacgtccgcctgatcaccgggcgggtccgcgccgcggtgcccgaggtcgacatcctggtcgccgacgacaactcgcccgacggcaccggcgccatcgccgacgagctcgccctcgccgacgaccacatcttcgtgctgcaccgccagggcaaagagggcctcggcgccgcctacaaggccggcttcgcctgggccaaggacaagggctacgacgcggtcgtcgagatggacgcggacggctcgcacgcccccgaggagctgtcccggctgctcgacgcgctgagcggcgccgacgccgtgctcggcacccgctacatcccgggcggcagcgtgcacaactggccgatgcgccggctgctgctctcccgcggcggcaacatctacatccggatggccctcggcatgccgttccgcgacgccaccggcggctaccgcgcctaccggatgaccgtcctcgacgccatcgacgtcccgtccgtcgcctccaccggctactccttccaggtcgaactggcctggcgcgcctaccgcggcgggttcaagctggtcgaggtcccgatcaccttcaccgaacgcgagcacggcgtgagcaagatgagcggcaacatcttcaaggaacagctgctgcgggtgaccgtgtggggcgcgcaggcccgcaaggagagtctgctcaccctgctcggccgcaagccccggcaggaacagacctggccgtgacgaccgaggccggccccacgggccggcccgatcgtccgctcccgcgttgcccggcccgcgtcgcgggccgggcgcactcaggcaggtcgcaggttccggtgtcatgctggaggggcaccactgaaccggaggtctcctgatgcgccgtggcctgtccctcgccctaccgctgctgtcgctggccgaggtcgccgtcttcctgaccgtggcccacctgatcggggccggctgggcgttcctgctgctggcagccttcaccctggccggtttcgcactgctgcgccgcgagggcatccgcggctggcgcgccttccagcagtccgccgcggccggccgcccgcccggcgccgaggtgaccggctccctcgtcggcctcggcggcgcgctgctgctggccctgcccggcttcgtcaccggcatcgccggcgtcctgctgctcctgcccccgctgcgcggcatggcccgccgcggtgtcgagcgcttcgccgagcgccgcctcggcgccggcatgaccggcgacctgttcggcccacgcaaggtccgggtccgcgtcgacgacccgacggtggtcaactcctcggtggtcgacgccggcttcccgccttccccgcgccaccccgccgccgccatcgagggcgaaatcgtccgctgaccccggcacatgcgaacggccgccccctcaggggggcggccgttcgtcgtctatcggtggggtgtcggtcagcgcccgcggcgagtgcggacctcctgcaggcgctcgttgaggatgtcctccagctcggcgatcgagcggcgctccagcagcatgtcccagtgggtgcgcggcggcttcgccttcttctgctccggctcgctgccgtcgaccagccgggccacgctgccgtcgaacttgcactcccaggtggtgggcacctcggcgtcgacagcgaacgggacctcgaactggtgacccttgacgcacaggtactcacgggtctgtcggggcgccagctcggtgttacggtcggactcgtagctgactgcgcctagacggctgccgcgcagcatgcgttcgcccatgatcggcttcccctcgctcgtggtgctgctctcgttgatgtaacgaaaggggcggccgccggattcctgcgcccgccgagtctctatcggtcttttacccgcccggtaaaggcgatgtaacgctatgagcgtaaccggctggcgaccttacaccgcaaattgaacggtcgcgaagtggaccttggtccaaattgcgcccatttgacacatcttcgggtgctgcgatgtcggtcactcgcgccgttcaccacctattaaccccgccgatcccctccgtaccgtgatcaggcggtggcgatccgggtcgccgttccccctcctgttcggcaccgccggcggcgacctttgccaaaggctgccacaaccggcacctcaccatccggtcacagccgggacgtccggcaccccaccatccggtcacagtccggacatccggcagccgttccggccgcaggagccgggcggctgctccggtcgataaaggagaatgcgggaccgctccgggagtcggttcaagcctccggcgatgcggcctgcgccggtgcggccgccgccggacggctcgtgccgagcgccgccagcgccgacgccaggtcgctgacctgaccggtcagctgagccacccgctgatgcgcggcgtccgcgtccgcccgcgccgccaccaggcgccgctccaggtccgcccgttcctcaccggcccggcgcagatcttcccgagcacgatcaacttccgcggcggtacgccgtagcccatcccgctcggccaccacccccgccagctcctcgcgcaccgcccccgcctcggccgcggcccggtcggcccgagcccccgcctcggccaccgcccgttccgcccgggctagctagctaggccgtcgccgcctgctccgcgtcgcgccgagcatcgtcgcgttcggcgtgcgcggccgccaccgcccgcgacgtctccgcccgcacctcggcgacctggcgttccaccccggccggcgacatctccgaatgcagcgcctcggtcagcgtccccaccatctggtcgaggcggtccaccacttcccaggtccgggcgaccgacccggccaggccgggcgacgaccggtgccgcatccggacattccgggaggcgcgctggcactcaccgtcgttgtcccggcagtaccggaacggccggccggcggaggcccgctgcggaacgggtcgcccacagtgggaacagggtcgggtttcgatggcctcggcggcttggtcctgcgtcgtcatagcacctcccaccctaggccgatcggcgatcttaccgatgtcaccacgctggaccggcttccgcggcccgggtgcaggggggcagcgtgtctatcgcggtgtccggaccgcggcccgggtggagggggcagtgcgtgtaccgcggtgtccggattgcggcccgggtggagggtacagtgcgtgtctaccgcggcgtccggattgcggcccgaccggtcggaccaggcgtcattgccggatccgccgagagaaatgtgcggccaaggtcgccgtcgaactgtcgggttcgggattgcggcacaccgtggggatgccggtggccgggcggcaccgtacggtggccgccatggcactaccgttcgatctatgggggcagcgcggctgggccgcggctgaggtcgccggcgagtcgcaccatcacgaggcgatccgtgggctgttcggcggccggttgtcggccgggggagcggagatggcggtcagcgcgcagctgctgcccgatccggcgaacccgcacgaccgggacgccgtcaccgtctgggtgggcccggtccaggtcgggcatctgcccccggacgccgcgaaacgctatgcgccggctctggcgagcctggtcgcccgcggctggacgccgcaggtcggggccaggatgttcgccacgcagcgggggccgcacgacttcagcgcctcgatccgcctggacctggccgagccgcacctgatcgccccggcgaaccacccgccccgcgaggcgtatcggctgcttccgaccggcgcgccgatcgaggtggccggcgacgacgagcaccgcgacgtcctgatcgagttcctgcgccccgagggcgagtgctgggtccacaccaccctgcacgaggccggcgaccggacggcgacgatcgaggtccgcctcgagggcctccgggtcggccggctcagcccccggctcagtggcgagctcctgcccgccgtccgccacctccacgatcgcggcctcaccacctgcgcccgcgccatcatcagcggcgacaccgtcaccaccaggctcatggtgtacgccgtgaaagcccacgaactgcccgaaagctggctggacgccccgcccgaaggcgcctcaccggccgggccgaccgtcccggagcccatggcggcgcccggtcgcccggccgtggtccccgccctggaatcgtccccggccgccgaaaccgcggtcctgcccgcgccgctcctgtcggccccggtcaccccggatccggccgccggcgcccccgtgccgtcggcgtcgccttccccggttccggccgcaccgccgtccgcgcctccgccggggacgcccgcgccgtccgggctcccgacggcgttgccgtcaccggttgtgcccgcaggcgtggtggcgccgccggtggcacctgtgcggcatcccgccccccgcccgcggccgacgcccgagtcgaattcggcggccgacaccgctgtcctgtccaccgcgccggccggctcgcccgtgaccatgcccgcggtaccgggccaccccgcggaggtcggccggcgcacggtcccgatcgtcccggcgggcagcggccccgtccctgtcgttccgggcaccgtcggcgcgggtccgggcggtgcgcccggcacgccgatgccggggcccaccgccgatggcggattctggggcgcaccgagtatcgagcagggggacgctgccggcgcgcctgagttccccggcactccggatggccggcacggcgggagttctggtgtcccgggttcgccggtggtcgggcagggcgggagttctggttcgccctagctagctagcagtctggcgaggtggcagctccggctcgcccgccgtctgggacgttggggtctccggttcgtcgacagccgggcagggtggcggcttcgattcgctgagcccgggggtcggtgggccggggcggcattcggtgtcgcccggctccccggcgggtgggcacggcgccttcggcttgcccggcgcggcgggtggggggcgcggctcggaggctcacgacgtacgggaaaccggttttgcggaaactcgcggcgcgcaagcgccgagatcgccgcaagccgcgcatcggccggccggtcttcgcttcaacccgccgccggcctggccggcgccgcccgcgggctggacgccgccgccgggctggacgccggatccggcctggggtccgccgccggccgggtggcaactgtgggtcgaggaccgcggcttctcgccgaccgatcctgccgccgggcaccgccaccccggcgccatcgatgtcgactggctgcgcgcggggtctgatgcgacgaccacggagttcgaccgcatacgtcccgacggtgaggcctgggtcccggatgtcgcctcgcccggggatggcggcgacgggtggcccgcggagggtgatcggtcgcgggttggcggcgacgggtggcccgcggaggttgatcagtcccggggcagtggcgacgcgtggcccgcggagattgatcagtcccggggcagtggcgacgcgtggcccgcggagggtgatcagtcgtggggcacgcgtgacgtccgggccccggaattcgctgacgcgcatggcggggcctccgctgtcgggttcggtgatccgctgtccggtggcgacggctgggccgcggagttcgatcaagggcgggcggacagtgacgcgctccacgcggagctcgggcgggtacgggcggaccgcgatctggcggtggcggagctcgaacggctgcgggcggatcgggacgcgctggccggggaggtcgaccgggcccacgctgaccgggatgtgatggcggcggaggtctcccggctgcgcgcggaccgggaggcgatgcgatccgagatcgagcggcttcgggatgagctgggcagggtgggccaccccgaggtccccgatccggggcgggaccggcggcgggaggatttcgggggctaccggctgcggtgaccggccgatgccggggcaggcgattcctctgatggcccgcctgtcctggcgaagcgtcgcgatgtggcccggcggtggctgcgtgccacggctgggcgtcgcggtgcgggcccgtgggtcatgtccgcttgaccagctccctggttcggggtggcaggatcatgcacagcagtgtgccggctccggcggtggcgatggcggcggccgggctgccccactgggcgagcacgcccagcaccaccggggagaggccctgcagggtcatcagcccggtggagagcagggtgaacatctggccgcggcgtccctccggggtggcgtccagcagcgggcgttgcaggccgagctggtaggcgtatccggcgccggcgaggaccaggcagcccagcgtcgccggcagcgtgggcccggtcagcagcaggagcagcggcgcgccggcgagcaggatgagcgggcggaccaggcgttcccgggtagccgggcgcacccagcgaccgacgatcaggtcgccggcgagcatgccgaccgggacggccgccatcagcgcgcccgcggcgccggccgggaagccgcgcccgtgaccgtacgagacgagcagtgcctccgcccccgcgacacacgccgacggcagccactgggccagcaggaaggcgcggatgatcgggtcgccgagcaggtcgcggacgccggccaggctggcgcgcaccgcggagccccggtccgcggattcgccggcgaggtcgggcagcccgagccggatgatcagcgcggccagggcctgcccgccggccgcgatcagcagggcctggcgcggtccggccgcggcgacggcgacgccgccgagcgcgaggccgagcagttgcgcgccggacgaggcggcgttcagaacggagcggcccagcacgtacgcgtcaccggtcagcacctcggcgaccagccgcccggccgcgcccatgaagatcggtgtcccgcaggccaccaccccgatgatcgtcagctgggcggcgaccggcagcggcaccaccgcgatcagcagcgccgccaccccgccggccaggtatccggtgacgatcagcggccgtggccggatccggtcggtcagcacgccgagcagcagcccacccgcgagttgcggcaggaaaccggccgcgaacgcgagcgcactgagcagcgccgacccggtccgttcgaagacgaacacggacagcgcgaagatccgcagcgattccgccgcgatggccgcggtccggcccagaaacagcacccggaaccgtggttccgcgaagacgtcgcgataggtcacccggccaccctccggcccggcgcacgctgctggcgattgattcgccaggaggcgtaacgtcggcgtcgtgatgcggttcgaggtcggcgccgaggatctgctgcacacccggttcgcggtgtcgccgatctttgagctgcacaatctgctacgggccctgcacgcacccgccccgggtctccccgagtcctggctggcccgtttccggcccgctttcgatcagctgcgcccggacccgtggctgaccgccgtcctcgcgctgaagtcggcccgctccggcgcgaacttcttcgcaccgccgcctcgcggcatgacccagaccatcgaccaggacctcgccgcgatccgcgcggtcccgctccgcgcggcccgtaccgaaatcgacttctatctggcccgccgccgggttccggccccggtcagaattctgctgtacgccgatgacgtcctggaccggatggccgccttcctgtcggacgcctggtcggcgctgatggcgccggaatggcccacgatccgtgccgtctgcgaacgcgacgtcgtccaccgctccgccgaactcggccgcgccggctggtccgcggcactcgccggcctcgcccccaaggttcgctggcaccgcggcggcattgaactgaccgcccaccgcggccccgccggcaccctcgacggcaccggcctgctgctcatcccgtccgtcctgatctggccccgcaccgccgtcttcggcgacgacccatggccgaaagcgatcgtctacccggcccgcggcgtaggcaccctgttcgaactgtccccacccgccgtcccggacaccctggcagccctgctgggccgcagccgagcccagctcctcaccgccctggccgacccggccagcaccacacacctggccaccgccttcaacctggcccccggcgccgtcggcgaccacctgtccgtcctgtaccgctccggcctgctcagtcgagcccgttccggccgctccgtcctctactcgcgcaccccgctcggcgaccagctcgtccacaccgcccgctgagacccccgcgcgtgtggtcgcacccggcccgtcggccccccgggccccgttcgccgatcgccaccgccggcccggggcccgaccggcgccggccgccgtccctggatcacccgctggaacccgccctcaacgccttcggtcctgccttcgacggccgccgtccctggatcacccgctggaacccgccctcaacgccttcggtcctgccttcgacggccgcctgaccgctggccgccaccgatcccggaaggatcgagtggcaccgccttctcgacagacccggcgtgcgcggtccggtgtcggctggccgggtggacggtcccgtgtcggctggccgcacgggcggtccggtgctgcgcggccttactgcggaccgggtcgccgactgaggtaagcgcgacgcaagcctggcgggtggtcgaccccggtcgcgcggcgacgcgtaatccgcggcacattgccgccgttctcctcgaccggccgggctcgcggcgacgcgtaatccgcggcacattgccgccgttctcctcgaccggcccggctcgcggcggcggccggatcgtgcctggtgccgcggtggccggcggctgcggacggggcgccatggcccgaacgtcgttccacccgaccccaaaaaatttatgatcatctgtttgatgaggatttgtggggtcaagttctccgcgatggttgccaatgactacataggaggacaaactatggcatcccgcaccgtcagcgccgccgttgctctcgtcggggcggccggcctctcgctggccgccgccgtccccgcgcaggccgccaccccctgcgtgcagaaggtctcggtgatcaacaacggtggcttcgtgatcgacttccaggtcaccacccgcaccggggagctgtccgcgtccaccgacgactacccgatcaaccagtaccgcgtcgtcgacctgaactcgaccccgttcgccgagggctccgacgtccgcccgctggtccacgcgcaggccggcaacaccgtgcccggcaacgtgttcgtgtcgttctgcaacaacgggcagaccgccacctacaccgcgagcggcaccaccctgaactacacggtcaccctcctcacctgaccgggccctcgcgggtcggttacggtccggccccggaaacagcgggcgtcgacacccgaccgcccgctcagtccgaacggggcagccggccgctccatccgggccggcgagcaccgggcacccccatgcggccgcgcattcggcacgaacgatgcggtcagggccgaggcggtgagagtcgacccgctcagtcgactgagtgtccggcctcaacgatgcggccgaggcgagggcgagcacgctcactcgacccggcgcgcccggcgtgaacgatgccgtcccggacccgcccgggcccgggcggcatcgccgacccggtgaggctccgccatgacgggacgctcgacgcgatctgcatgtgaagagcctccctcgggggtacgacactttccgatgtgcaaccttcggttgctcaagagccgatggtgggctaccgttacctgcaaccaaaggttgcaggaggacgtcatggagcagggaatcatcgagcgcgaaatcttcatcgaggcgacgcccgaggtcgtcttcgaggtggtcagcagccccgaacacctcaagggctggtggcccgacgatgccgactacgaagcgcggccgggatcggagggaaccatcaccttcggtgactgcagcgccggaggcaaggtcgtccagttcgccgtcgtcgatgcccgtccgccgcgaacattctcgttccgctggacgcaccccgccggtgagccgccgacggccggcaactccctgctggtcacgttcgagctgactccgtccggcggtggcacgctgctgcggatgacggagaccggtttccgggagcggggctggtcgcaggcgatcgccgagcaggagtaccgggagcatgtgcacggctggggcatcttcctgccgcgactcgcgccgtatgtcgccacgctccaggtccagccgtgagcacggccgtcgacgacgatctgtggtcggcggtcggcgacccgacccgacgacgaatgctcgacctgctcctcgcccacggtgagggcaccgcgaccacgctcagtcagcagatgccggtgacccggcaggccgtcgccaagcatctcaccgtcctcgaccgggtcggcctggtccgcggcacccccgccggccgggggaagcgttaccgcgtcgacgacgcccagctggcccgcgccatcggccagctggcctcggtcggcgcggcctgggacgcccgcctgcgccgcatcaggaccatcgccgaggcgatccagcaaaccacgaccgattgagccgtacgcccgcgacgccgcgtccccaccgggatgcggcgcgccatcttcgccgccgcaactccacgcgccgggtccgtcagtcgaggcagaattcgttgccgcccgggtcggccatgacgatgtgtccggcgttcggcggcaccggctcatggcgttgcacccgggtggcgcccaggcccaccagtcgcgccgcctcggcttcgagggctgccatccgctcgtcgccggtgaggccgggagctgcgcggacgtccaggtgcacccggttcttcgccgtcttgccctcgggcaccttctggaagaacagccgcggcccggcgcccttcgggtcgatcagcgcggaggcgtcgttgcgacgctcgggcggcacaccccacgcctcgagggcctgctcccatgaggagaagcccgcgggcgggggctgcagccggtagccgatcgcctccgcccagaacgcggacagcgcggccgggtcggcggcgtcgaaggtgatctgaagctcgcgtgcgatctcaagagacatgcggtccagcctgccgcacattgcggtcacccggtgtcctgaaacggtcagcgctcccgccggtcctgaaacggtcagcgctcccgccggtcctgaaacggccagggctcccgccggtcctgaaacggccagggctcccgccggtcctgaaacggccagccctgcccgcgccggtgagcggcctgaatggcggggccgggagaccggggcgtcaggcgccggcgagcggcggaccgacgtggtcgtcgagccagtgccgcagcggaaggccggctcgcaggaactccaccacccgcttctgcgcggccgccgtccccagccaggcggccggctcccattcccgccaggtgatcagccccttgtgccgcagcagatcgatccggggatgatctttcgggtagccgcgcggcgcggttttcagggtgtctctgccgaccaccgagattccggttctctcgatgtcggtgatgagggtggtcagctggatgccggtcacgtcgttggcgatcgcccgccggaaccggtcgagctggcccggatccatccggtagtagccggatccggcggccagcccgtccgcgctcagctgcaggtatccgccggattcgagccaggcgcccagatgcgtcttgtacggggtcttgtccttgctgaagcgcacatcccggtagggccggaacactttccccggcccgaattccggttccagggcggcgagcagttccagcatcggcccccgcacctgctcctcgtagaatgccaggtgcctggtccagtacgtcttcgagttgtcggcgccgagcccctcgtagaactcgagtgcctcgaccggccatccgcggaacgtcacccaccgattctgcgccatcggcaagacgaggagccgccgggacgcgtggtcagcgggacggcagcccgagccgctccagagtctctcgcaaccgatgccgcccacccagcgcttccgccccacccagccggctcagcacccgctcactccagccgccgctgagcccgaaccgccggttgtaggcggccagccgttcgtcgtagaccgggatgtgcgcgtcggcggcgtccgcgtcgtactgctcatggtgcagcaccgccgcctgcggcagccggggtttgaccgcggccgcctccgccgggtcgggcgtgccgacggccaggccgaaggcggcgaccgcgtggggcggcagcttgagttcggcggcgatctcctcgggtcggttgcggacggcgccgacgaagacggagccgaggccgagggattcggcggcgatcaccgtgttctgggcggcgagggccgcgtcgacgaaggtgatcagggtgctttccaggtagtccgctccggtgagggaggagccggcccggtcggcgaggcggcgggcgcgggacaggtcggcgatccagaccaggaacagcggggcctgcgcgatgaaggactggttgccggcgagggtggcgagccgctgccggcggcccgggtcgcggaccgcgatcacgctccacacctgcaggttggaggaggtggcggcggattgtgcggcggcggtcagcgcggtcagctggtcgtcggtcacctcgccgggcaggaatcggcgcaccgagcggcggcgcagttgcaggcggatggtgtcggtgagggtgtcgagcggcgcggcggcggtcccgtaccgggcggcgagcagttcggacacgggcgtctcccggaagcttgaaaagtcggcggcatccatatattagctatagaggtgataggaaaagcgagcgagttcctctggtacatcccgaacgaggaccgccccgggcaccgcggcgacgacgtggtcgacggccacaacagcctggcggcgctcaccgcgcaggccctggcctgcgagcggcacggctggagcggcgcgctgatcggcaccggctggggccgtccggacaccttcacggtggccaccgcgctcgccgcccgcaccaccacgttccggccgctgatcgcggtccgccccggctactggcgtccggcgcagttcgcgtccgccgcggccaccctgcagcacctcagcggcggccgggtgctgatcaacatcgtgtccggtaaggatcgtctcgccgcctacggcgacgaggagcaggaccaggcttcccggtacggtcgtacccgcgagttcctgcacctggtccgccggttgtgggccgaggagcacgtcacgcaccggggtgggcatttcgcggtcgacgactcgaccgtggtcccgcgcctggccacgcccccgcggctgtatttcgggggtgcctcggccgcggccgagcgggtcgccgccgcggctgccgacgtgcaactgttctggggcgagccgctggacggcgtacgggaaagaatcgagcgcctgacggccctgagccgggaggtgggccgggacctcccgccgctggagttcggtctgcggatcaccacggtggtccgcgagaccggcgcgcaggcctgggcggatgccgaggcccgggtggccgcgatggccggcggcccggcgatcgacccgctgtgggcggcggcgaccgggcagcgccggctgctcgacctggccgcccgcggtgacgtgctggacgacaatctgtacaccgcgccggcccgggtcggcgggggcggcgcggggacgacctggctggtcggctcggccgcggaggtggcgaggtcgctgcgcaagtatcagaatctggggatcagccacttcgtgctgtccgacacgccctacctcccggagatcgcgaggcagggcgggcagttgctgcccctgctggcggagaccgcgctcagagcgtgaagccggccaccagttcgcgcagctcgctgctggtccgcgccaggttggcggcgttcgactgagcctggttgaccacctcggtggtggtgcccaccgcggtcgccaccccggcgatgctggtcgcgatcgcggtgctgctgtcggccacctcggcgacgttgcgtcccatctcgctggtggtcgcggtctgctcctcgacggcggccgcgatcagggtctggaagtcgctgatccgggccaccacgtcgccgatcttgccgatcgcgccgaccgcctcggtggagtccgcctggatcgcgtcgacgagccggctgatctcctcggtggctttcgcggtctcctgggacagctccttgacctcgccggccacgacggcgaagcccttgccgagctcgccggcgcgggcggcttcgatggtggcgttgagagcgagcaggttggtctgctcggcgatcgcggtgatcatggcgatcaccttgccgatctcggcggacgactcgccgagcttgccgacggtctggttggtgcgggcgaccacgccgaccgcctcgccggcgacctgggcggcctcgccggcgttgcgggcgatctcgtcgatcgccagggtcatctcggtgctgccggcctgcagcgtctgcacgttgccggagacgtggtcggccgaggtggcgaccgcggtggcctgggtgtccatctcgctgctggccgcggcgatctgcgtggagacgtcggagaggtcctgggaggcggccgagacggtgccggcgtgcccggcgatcgccgcgaccgtgtggctcagcgactcggcggtcgagttcaccgcgtcgccgagcgttcccagctcgtcgcggcggtccaggctgacccggacggtgaggtcgtgcgcggccagacgtttgagcgccgcgaccacggtggccagcgggcggatcaccgagcgggtgacccaggtgcccatcagcacggcgaggatcacggccagggcgagggcgatggccagcccccgcatcgcgtcggtgcgcacccgctgcacgtgggcgcgcagcgccgcggtgcggtcggtgaccgacttgtccagtccagcggtgatgtccaggaccttgccgtaggcggcggccgcatcaccgccgttgatgctgtccatcgccttcgcgcggctggcctgggtgtccgccgacagccaccgcatgacggtcgtgtcccaggtgaagaactcgtcccaggcggtcttgagcttggcgaactcggcccgctcggccggcgacatgtcagccgtgtcggcgctggccagctgagcgtagatggcggccttggacttcatctcgccctgccggttgtagcctttcggcccggtcgcgaacgcgtagccgaacgcgccgatgtccgcgatgaccaggccctgccagccggtcacgtcggcggcgttgtacttggcggtctggatgtcgtcgcgcacccgttccagggcggccagttccttctcggcggcggcctgctggcgcagcccggaccagccgacaccggccgaggtgacgatcagcgtggtgaggaccaggtaggaggcgcccagccgagtgccgacgccgatgtcacggatgcgcatgcacctgtgatcggcgcgaatcctatccgtctgagggtagccgccacgtaagatcgtcgacggtggggtagtgcccggtggaaccggggagtcagcaccactgtcaccggtccagtgcgttcgtacggtgttacccatgaccgacgcggtacgtctcgaagccctcgtcaagacctacgacaacgccgtgaccgcgctcgacggggtcacggccgccttcgccgacggcacgttcaccgccgtgatgggcccgtccggctccggcaagagcaccctgctgcactgcgcggccggcctcgaccggcccagcagcggccgggtcttcctcggcggcgccgaactgaccgcgaccaccgacaccgaactcacccgcttccgccgggcccgggtcggcttcgtcttccaggactacaacctgctgcccgcgctcaccgtcgaacagaacgtgcaactgccgctgcgcctggccggtcgccgcgccgaccgcaggcgcggtcgggccatcctggaccagctcggcctcggcgaccggctcacccagctgcccgccgaactctccggcggccagtgccagcgcgtcgccgtcgcccgcgccctgctcaccgaacccgcggtgatcttcgccgacgaaccgaccggtgccctcgacctgcgcggcgcccgggaggtcctcaccctgctccgccaggtggtccgcgaccacggtcgcaccgtcgtcatggtcacccacgacccgatggccgccgcgtacgccgactccgtcctcttcctggccgacggccgcctggccggctcgctcgccgcacccgccccggacgccgtcgccgaccgcctcgcccacctgaccggggtgccggcctgacctcccgccgccgcggccgtgctcggcaccactcgccgcgcgactgccatcccggccatcgccgccctccactgaccaccgcccaccccggccggtcactcgccaccccggccggtcactcgccacctcggccggtcaccgtccaccccgacctgcttgcgttcccgtcccggggcgccgtcgtcgcacacgagcagagccgaccgtctccacggccccgcggggtcagagggagagcagctccgagacctgcggggcgtatgtcgtgtgcaggaccagggccgccgcgccgacgaccgccgcgtcggcgccgagcggggagacctcgacacggacggtgcggatgctgcgggccagggggcgggtctccaaagctttggcggccgcgtcgcggaagcgggattccaggtggcgcaggccgtgcccgccgaggacgaacaggtcgacgtcgaggatgttggcgacgttgacgacggcggtggccagatgttcggccgcggcctcgacgacgtcgacggcggcgcggtcgccgtcgagcgcggcctggcgcagggtgtcgtaatcggtcaggccggaccgggcgacgagagctcccgggctgatcaggctctccaggcagccgcggttgccgcaatagcagggcggcccgccgggcagcaccgtctggtggccgaattcggcggcgttcatcgagccgccgcgatagacctgctggcccaggatgagtccgccgccgacgccggcgccgaagaagaagtaggcgaagtcggcgacgccgcggccggcgccggcccagcattcgccgatggcggcggcggtcgcgtcgttgtccagggtgaccggcaggccggtggcggcggccagcatgtccttgagcggcacccgggtccagccgagcagctgcggcggcccgaccagggcgccgaggctctggtcgatcgggccgggggtggccaggccgaggccgaggacccggtcgcggggcacgccggcggccgcgagcacgtcggtgaccaggccggcgaccgcggcgacgacctcggtggggccggcgccggggcggatcggctgctgccgttggaccagggggcggccgagcaggtcggcgaccacgcaggacagctgggacgggtcgaagtggacgccgacggccagccccgcggcggcgttgacccgcagcagggtgcggggtttgccgccgttggagacggtggcgccgtcctcgcggacgatgccttcgccgatcagccgccggacgatgccggagacggtctgcggggtgagaccggtcagctcggcgatctcgacccggctgatgccgtcggcgagctggatctgatcgaggacgacggcccggttgtactggccgactttcggcaggttggttcctgtacgccgcaccggaataccgcctctcccgaccccatcatccgttcggacgacgcggttacggaaccaggaaggaacgttgcgagattgatgccgaccatgatgccatcgacccgttgacttagtaaataaataagatttacagtctggaaacgccgacgtcatcgaagtcgatctttgcgtaacgcctgttgggaggcgccatgagcgctgctgcgccgctgctcgaaatgcgctccatcaccaagacgttccccggtgtcaccgcactgtccgatgtgaacctgacggtccgcgacggggagatccacgcgatctgcggggagaacggggccgggaagtcgaccctgatgaaggtgctcagcggcgtccacccgttcgggtcgtacaacggctcgatcgtctatcgcggggccgaggcccggttcgccgacatccgggccagcgagcacgccgggatcgtgatcatccaccaggagctggccctggtccccggcatgtcgatcaccgagaacatcttcctgggcaacgagccgacccggttcggccggatcgactggaaggcggccaaccgccgggtgctcgaactgctcgccatggtcgggctgaacgaggatccggacaccctggtcaaggacatcggggtgggcaaacaacagctggtcgagatcgccaaggcattcgccaaggacgtacaactattgatcctggacgaaccgaccgcggcgctgaacgagaccgactcccggcacctgctcgatctgctgcgcgggttccggaaacgcgggatcacctcgatcatgatctcgcacaagctgaacgagatcgaggcgatcgccgactcgatcaccattctgcgcgacgggcggacgatcgagacgatcgatgtcgcggcggagggggccgacgaggaccggatcgtgcgcggcatggtcggccgggatctgggcagccgtttcccggagcacgagccgcacatcggcgaggtgttcttcgaggtgcgcgactggacggtccggcatccgatctcggccgagcggctggtctgcaagaactccggcttcaccgtgcggcgcggggagatcgtcgggttcgccgggctgatgggcgccggccggaccgagctcgcgatgagccttttcggtcgcagctacgggatctacctgagcggccaggtgttcaaggacggtcaggagatccagttgcgctcggtggccgaggcgatcgggcacggcctggcgtacgtcagcgaggaccgcaaggcgatcggtctgaacctgctcgacgacatcaagacctcggtggtcgccgcgaaactctccaagatcaccaagaacggggtgctcgacgaggccgcggagtaccacgaggccgaggcgtaccggcgcagcctgcggatcaagacgccgagcgtggacgagggcgtcaccaagctctccggcggcaaccagcagaaggtcgtcctggccaagtggatgttcaccgacccggatctgctgatcctcgacgagcccacccggggcatcgacgtcggtgcgaaatacgagatctacgggatcatccagcgcctggccgccgagggccgcggcgtcatcgtgatctcctccgagctgcccgagctgatcgggctctgcgaccggatctacacggtcttcgagggcacgatcaccggcgagatcgcccgccgcgacgccgacccggaagtcctgatgaagcagatgacctcgacgaagaagctggccaccccatgagtcggataaaagatctccagaaaaacctcttcggcggtacgacgtcgaacgcccgccagttcgggatgatcttcacgctggtggcgatcatcgtgttcttccagatccgcaccggcgggctgaccctgcagccgggcaacctgatcgcgctgacccagcagtacgcgtacatctcggtgctgtcgatcggcatgctgatggtgatcgtggccgggcacatcgacctgtcggtcggctcggtcgcggcgttcgtgggcatcgtggtcgccaaggcgatcagcgtgcaccacgtcccctggccgctggccatcgtgctgggcctggtcgtcggcgcggcgatcggcgcgtggcagggcttctgggtggcgtacgtcggcattcccgccttcatcgtcacgctcgccggcatgctgctgttccgcggcggcaaccagtacatcggcaacgccgacacggtgccggtgccgccgggcttccggcagatcggcgccggctatctgcccgaggtgggcccggacaccggctacaacaacctgaccctgctgctcggcctgctggcctgcgtcgcggtggtctggcgggaactgcggtcccggcaggtccgcaagcagatggagggcgccgagccggccccgatgtgggtctcggtgatccggatggcggtgatgatcgccgtcatcatcttcgccacgctgcgcttcgccggtggccgggtcggtaccagtttcccgatctccggcatcatcctcgccgtcctggtgatcgcgtattcgttctacacgcgcaacaccgcgggcggccgacacatctacgcggtcggcggcaacgcccgggccgccgagctgtccggcgtgcaactgcgccgggtgaacttcctggtcatcatgaacatgtcggtcctggccgcgctggccgggatgatcttcgtggcccggtccacggcctccggcccgcaggacgggctcggctgggaactcgacgcgatcgccgcggtcttcatcgggggtgcggcggtctcgggcggtctcgggacggtcggcggctcgatcgtcggcggtctcgtgatggccgtgctgaagaacggtctgctcctcaccggcaccggctccgacatggaccagatcatccgtggtctgttcctgctcggcgccgtcgccctggatgtctacaacaagaagcagggccgcttctcgatcatcggttcactcacccggcagttccgtccacggcatgaggtggcggccgccgaaaccctcgcagaggaccgcgagaagacccctgcaacccgcatctagaaaagggttgagtcaatgcgctccttcatgatcaagagtcttgcggtcggcacggccgtggtgctcgccctgtccgcctgctccaacgaccgcaccaagtccggtggcgacaccggcaacaccaagggcttcgccaaggacggcctgatcggcgtcgccctgccgtcgaagacctcggagaactgggtgctcgccggtgacctgttcaccaacgggctcaaggatgccggcttccagtccgacgtgcagtacgccggcgcctccaccacggtcgccgaccagcaggcgcagatcaccgcgatggtgaacaagggcgccaaggtgatcgtcatcggtgccaccgacgccggtcagctgaccaaccaggtggcggcggcgcaccaggccggcgccaaggtcgtcgcctacgaccggctgatcaccaacaccccggacgtggactactacatcgcgttcgacaacttcaaggtcggccagctgcagggccaggcgctgctggacggcatgaaggcgaagaagccgaagggcccgtacaccatcgagctgttctccggctcgccggacgacaacaactccggggtgttcttcaacggcgcgatggacgtgctcaagccggagatcgccagcggcaccgtgatcgtcggttcgaagcagaccgacgtgaagcagaccgcgacccagggctggaaggcggagaacgcgcagagccggatggacgcgctgctcaactccacctacaccggcggcaagacgctggacggcgtgctgtccccgaacgacaccctggcccgtgcgatcatcacctcgatcaagggtgccggcaagcccgtcccggtggtcaccggccaggactccgaggtggagtcggtcaagtcgatcatgaagggtgagcagtactcgacgatcaacaaggacacccgcaagctggtggccgagacgatcaccatggtcaaggcgctgcaggccggcaacgagccgcaggtcaacgacaccaagtcgtacaacaacggggtcaaggtggtcccgtccttcctgctgccgccggtcatcgtcaccaaggccaacgcggccgaggcgtacgcgaacgacccgaagctggagccgctcaccaagagctgaccgtcagcaccggccagggcgttcccgatccggggacgtcctggtgctgttcggcgggatccgttcgaccatcgagaaggaggcgttgagcaggcctcgcggcgtctggatctggtagcggctgcgaccctgcttgacgatggtgccgagcacgccgccgtacttgccgccgccccgcaggcgcacccggtcaccgaccgcgagggcgacgggggcggcaccgtgcaaccggaccagctccgcgacgtagtccgggtgcagcggcaccggatggccacggtaggtccaggcgaacagcgccgaccggttgaaccccggcgaacagttccggcacgaccgcacccgcaccggccggcggtgcgccgtggtccggtgcccctgccggcagaacccctcccacgccccgtcgacccggggcgcctcctcgggcacgcagcgccggcccgaacatccgatccgcaccgcgatcgcccgccacacctcgtcgtgcccgtgccgggccccggccagcgcgtgcgcgatctcgtgtaagaccgtctcggtcacctgctccggcgaatacaggctgatcagcggccgggacaggccgatctcccggcgccccggccggcacaccccggcccgcgtcttcgcgtcgtcgaaggtcagccgccagcgggacagccggtgctcggccatcaaccgcagcgccagctcccgtgcatcgctcagatccaacccggaactcctccccgctccccaccatgatccctcaagcgggcgcagcggtcccaccggcgagcaggtcgggcaggcgggcggggagggtgcggatccgggtgccggtggcgtcggcgaccgcgttcaggatggcggcggcggggctgccgatgtcggaccgggacggctccaagccgtccacccaggcggcgtcgatccaggcgatgtcggggtacgcggggatgcgggatccgcccggggcggaatcggtccaggtgcccccctcggggtcgggggccggcgcctcgtgcagggccatgctcacgcccgcgaccatgtcgccgaggaaccgggaccgggtggctcgcgcgtcggcggcgtcccgggcggtgtacacgccgaacaggcgggtgaccccgacctcgccggtgacggtgctcacccgtacctccgcgaagtgcgccccgcccgcgaggccggtgccgatcagccactcaccggcgcgcccgtgcgggcgatccggccagccgaaacgggcggcgcccgcacgcaggcgccgcaagcagtcgccgcggagattccgctcccggaaggtcagcggatccatgccgatcgacagggccagctcgtccagcgcgcactccagcgcgaccgtcccgggcgtccgcgccgagcgggacggcggtacgtccagcgggacggcccggtgccgcagcgtcaggtccgggacgtcgtatccgccgtgggggaccacccccggatcgcggaagcggctggtcgcggtccgcaccgtgtggtcgatggcggtcagccggccgtccggggtggcgctgatccgcagccgctggacggtcggggcccggaagccggccgggtgcggcgacgtcacctggaccggccgtccggtcacccacgcgcccagggcggccagcacggcgtccgggcgaaccggaccgctgccgccgccgggcccggggatcacgcggacgtgtccggtgggcaggccgaagagctccgcgacggtgtccgggtcctggccggaagcggacaactccagccgctgaccgtcccagcgggcgatcgtggcgggcggctccagcggaccgtcgggcgcggccggcgtcgtgtagacgacgtcgacgccggggtttgcggcacccgacatggcgtcgatgccggtgcccggggtggtcggtccggggtgggtcgtgtccggcgtcaggccgatgtcggtgcctgcggcgggcggtccggggtgggtggtgtccggcgtcaggccgatgtcggtgggcggtccgggatcgatggcgcggagcacgacgtcgtgccgctcctcggtgatgtcccaccgaaccagccgggcggcgcggcgggcgccctccagggtgtcggcgacgaccagggcgaccggctgtccgcgatgggcgatccggtccgactgcagcggcgggggctccggaccgtcgaatccgggcgggcccgggacgctcgccggggtggacggtgatggcgcgcccgccccggccgttgcctccggggacccggctccgggcaggtgcgggacgttgccgtgccagaggacgaccagtacgtcgtcgtcctcggccgggtcggtgaacaccgcgttcagccggccgcgagcgaccggggaggcgacgatccagccgtacgccaggccgtcccacggatggtcggccgcgaagcgggcggcgccggacacctcggctagctagctagcggtgcggccgagcatggtcgtcatcgggcgtcctcggtcagcgactccagcacggcggcggtcaggttacggatcaggggaatcttgtacgcgttgtcccgcaacgggcgcgccgccgccagttcggcgtccgccgccgcgaggaaccgctcccgggtggccggcccaccgcgcagcgcctcctccgcggccagcgcccgccacggtttcggggccaccgcgccgaacgccagccgcacctcgcggaccaggccgtccccggtccgcagcgcggccgcgaccgagcccgccgcgaacgccgaggaggcgcggtcacgggccttccggtaggccgaccgagccgcggccgacagcggcggcaggtcgaccgcggtgatcaactcgccgtgttccaggacggtgtcgcgctccggttcgtccccgggcaggcgatacagatcggtcaccgggatctcccgggcgccggccggaccgtccacccggatcaccgcgccgacggcggcgagggccaccgccagatccgacggatgggtggcgatgcagcctgccgaaccacccaggatcgccaggtcacgatggtcgccggtgcgggccgggcaccccgagccgggcaggtgcttgttgcacggcaggccggccgccaggaaatatcggcagcgggtgcgttgcagcaggttgccgccggtggtcgccatgttgcgcagctggcccggcgcgccggcgagcagggcctggctcaccagcggaaagccggtccgcacccggcgatccgcggcgagatcactgttgcggacgccggaaccgatccggatcgtcccgtcggccagcgtggtgatgtcgtgcagcggcagccgggtcacgtcgaccagcacgtccggggcggccacgccgagcttcatcagatcgaccaggttcgtgccgccggccagaaacaccgcacccggttcgaggccgtcggcgagccccgacgccgtacggtaatcgaaggtcttcatcggcccgccgcctgccggatggccgggaccatcgccgggtacgccccgcaccggcagaggttcccgctcatccgctcccggatctccgcatcactgagcggatcgccctgcgggtcgctgtgggggccggcctccgcgtcgccgtgccgggcggcctgcgggtcgctcggcggaccggccgcgccggtgaccgcgctcgaccagccccgcgccacctcgtcgagcatgccgaccgccgagcagatctgccccggcgtgcagaacccgcacccgaatccgtcatgggccaggaaggcccgctgcaccgggtgcggatcggcggcatgtcccaggccctcgaccgtggtcacctcggcgtcctgctgactgatggccagaatcagacagctggcgacccgccgcccgtccagcagcaccgtgcaggccccgcactgcccgtgatcgcaaccgcgcttcgctccggtcagccgcagccgctcccgcagcaggtcgagcagcgtggtccgcggatccaggcccaccaggtggtgctgaacaccgttgacgctgatgcgcattccccgccgttacccccgaaagcccagctcaaccgcgttccccggcggccgctccgaacgtctggttgggtatgcggatggcgacctgcaacctctgccaccgtgacgtgcccgatgagcagatcgaggaacaccgccgcgacgtgcatccggacgtcgcggcggacggcacccgggagacggacgactcccggatcgtgccggattccaccgtgccgcccgctccgagggaggagtgaaacagaccggtttcctgtgggttccctgccgaagacgcaggtcgcggtacgcgcggccgacccgctgtgccggccgggcgatcagcgtcccgcagcggaggggaccagaacattgcttcgatcggtggcgttccatcgacgggcgccccggcacaccgatcgtgagtggacgactcgacgtcaccatgttgaacttttccgcccgagatccgttgaagagagtgtccgggcgcgacgaccccagcgccgcgcccgggcctctccccaccgcgagcccgcgaccccgccaaacgcggtgtcacagccgatccgccgatccgccaagccgcctcccacctcccgcctcccgcctcccgccgcccacctttcaccgtccgagccggctgtgaccggcgctgattcggccgagccgaacgggagcgtgtggcctgggccgagctcgccgtggatcagtggccgcgtccgaggtcgaggcgcctccgtcgcgggtttgatcttgcggggtgaccgcgcccgacagcggatgtggaagggggtggcgatcgtcatggacgcgccagcggccagatcgacgcgcccggtgcggcgggagcagcgatcggttatcggccggagcgcacgacatccggaatttgaagttgatcttccatctcgactttgatcttcataagaattcactacgggcttgatctttgaaggccggagccgccgcatatctcgggaatacgctgttttcgtgcggttgtcggcggtgctgttctcggtggtcacggtgaccgccttggcggtgtggtccgcgttgatgcccacccggatgttgctgttcggcaccgtggcgatcggtccggccctggccgcggccgccgcccttccctcggtcgtcctgctggtcggcggctatgcgttcgccgccgcactggccgtttcgacagctgagggtctgttcgggacggcggatcagtggttgcggctggcgttcatcgcgtgggcgaccgcggtgtcgtgggggctcgcggtgttccagcggcgggcgcagcggtcggcgtccggggcggcgcgggagcggcaggtgctggccgcggtggccgagcagtccggggacgcgatcatctcgacgagcctggacggcacgatcgtcgcgtggaacgggggagcgacccggatgtacggctggccggccgcggaggtgatcgggcgttcgctggccgagatcctgccggacgaccggggcgacgaactgcagcgggcgctgggtgagctggcagccgggcggcggcttcatctggacgagtcgcgccgggtgcgccgggacggaacgccgctcctgatctgcgcggatgtctggcccatccgggacgagaacggtgtggtggtcgcggcggcggccaccgagcgggacatcaccgaggagaaactggcccgggaacggtcggcgcgcgccgatcggctggagagcctcggtcagctggccggcgggatcgcgcacgacttcaacaacctgctggcgatcatcctcaattatgcggatttcctcgatggggaggtgtccggtgaggccgccgaggatctgcggcggatccgcaacgccgccgaccgggccaaggagctgaccgggcagctccttgtgttcgccaagcgggagccgacccaggtggaggtcatcgacctgaaccaggtggtgaccgaggccggcgagctgctcagccggaccatcggcgagaacgtgcgcctggtcaaccggccgtcggccgcgccgatgccggtccgtgccaaccgggcccggctcgaccagatcctgctcaacctggtgatcaatgccagggacgcgatgccggacggcggggtggtcgtggtcgagaccgacctggtcgaggtgggagaggggccggccgcgccgctgccgcctgggcggtatgcccggctcaccgtcagcgacaccggctgcgggatgacggccgaggttcgcgaccggctcttcgagccgttcttcaccaccaaaccacccgatcgcggtacggggttgggtctggccacggtgtacggcatcgtcggcgacgcgggtggcacgatcggcgtcgagtcggcgcccggggtcggtaccacgttccgcatcctgctgccgtcggccgccgtgccggccggcgcgtctcccggccccagccaggcggaactcgcgcacgggcacggcgagctggtgctggtcgtcgaggacgacgagttcgtacgggacctggtgatccggatcctgcgggacaacggctaccgggcgacggcgctgggcgacgggccgctggccgcgctggacctgcacgacgtggcactggtgatcaccgatgtggtgcagcccggccggtccggtccggcgctcgccgcccggctgcgcgcccggcggcccgacctgcgggtgctgttcatttccgggtacagcgacgccgatgtgcgccgggagcatcgcatcgaaccggaggcacggatcgtgcagaagccgttcaccgccgtcgaactgctcgccggggtgggcgaggcgctggccgcggctcacgcaaacggggcttgaccggcacacgatgttgacattggtgtccgggggcgggtgtactgcgtgacgacgttgtcctgactatctcccatcggggaacgtgcacagctcgggaaggcaggtgccgttgtggcgatcaccccggccgagatcaacggcatcgccttccggcggccgcggcccggtgcgtcgggctatcacgaggagcaggtggacgcgttcctggaggacgtggccggggagatgcgccgcctcgaggcggagaaccgggcgctcagctcccggctggggcacgacgacctggccgagcgggtgcgccgggcggagctggagtgtctggaggcgcaggagcgggcccgtgccctgcgcgaggcgctgaccgcggcgcgagaagcgtccttcactccggtcaatgcggataagtcgggcatgttggaggtcgctcagcggaccgcggatgcctgcgtcgaccaggcccgggccgaagccgagctgctcgtggagcaggccaccaccaaggccgcccaactgctcagcgacgcgcagctgcgggcgtcgacgatcgtcgccgacgcccggcacgcccacagcgaagcgatcgccggcatcgaagcccagcgggccgccaccctcgacgagatcagcgagctgatcgcgctcgccggccgtcagcgggcggcgaccgccgacgacatctccggccgcctgcaggagttcaccagctgatcggccggcatcggccgagcgaagtggaagccctgcgcggcccggtagccgagcgcggccagccggtccgcctgctccggcgtctccaccccttccgccacgatgtccagcccggccgcgccggccagggcaaacaccgcggccggcatgttcagccggcggccctgggtcgcctcgacgaacgagcggtccagcttcaactggtcgaccggcagctcgtgcagtagggtcagcgacgactgcccggtgccgaagtcgtccagcgcgatccggatcccggtccgccgcaacgcctccagcttgccggtcgactcctcgccgagcgccaccgcggtgctctcggtgatctccagggtgagcagttcggccggcatgccggtgaccgccaggatgtgcaccacccgctccaggaagtccccttccgacagttgccgcgccgacacgttgacgttcatccgggccggtgcgtccggacccagctcggtccgccacgcggcgtgctgctcgcaggcggtgcgcagcacccactcgccgagcggcacgatcagcccggtgcgttcggcgaccggaatgaactcgccgggcgggatcatcccgcgctgcggatgctgccagcggaccagtgcctccacgccggtcaggtggctgccgtcgagcgccacgatcggctgatactccaggcgcagctggccaccggcgatcgcctggcgcagctgcgcgccgagcgccgcggtgtcggccaccgcgccggccatcccggcggtgtagacacgcaccgtgccgccgccctcgtgcttcgccgcgtacatcgcgatgtcggcccggcgcagcagctcaccgggctcgtcacccgggccgtcggcgatcccgatgctggcccgcaccagcagatcgtgcccctcggcgaggaccggctcggccagcgacccgatcatccggcgggccaccggttccgcctcggccgcggtcagcccgggcatcagcaccacgaactcgtcgccgccgagccgggccaccgtgtccacctcccgcacactggcccgcagccggcgcgccgtcgtggtgagcagtgcgtccccggcgccgtgcccgagcgtgtcgttgaccgtcttgaagtcgtccaggtcgatcagcgccacactgaccggctgcccggcctcgccgccggccagccgggcgttgaacagcgcccggttcggcaggccggtgagcgcgtcgtgggtcgaattgtggtcgagacgggcgaccagaccggtgttctcccgcatcgcggtgatctgccgccacatcaccaccgcggtcagcgccaccgcgcccagcaccaccagccgctcccgcggatgcggccagcaggtggcgacgagcaggccgtcgatcgcgacgaccgcgaggtagggcagcacgctgaacggccggcggccaccgacccgcagcccggcccgggaggggcagctgttccgctgcacctcggcggccgcggtcgccaacaccatgatcagcggtacgccgagcgggcccatgttgagctccggccggtccgcgatgaaccgctgcgacgcgccgatcagcaccccgccgaagagtccgagggcgaacagccgcagcgcgttgcgggcgatgtagtgatgcccggccagtgccaccttggcgatcgcgaagatggtgaccagctgcagcaccatggtgaacccgatcaccaccggcgatccggtccgctggaactgccacatgaagatcgacgcggcgagcagcacggtcccggcgtccagcccgatccgcagccggtcgccggaccccgtcgagcccatcggcagtcggaacatgccggccatcagggccaccacacatccgccgtacgccgccaccgtccacggcgacatctcctgggttggcgcaccgtgcccgagcgcgtcgaccgcgttgcagacactgccgaccgcggacagcacggtgcaggcggccagatgcccccagaacatccgggtagggcgcggaaacccgctgatccgggtgatccgcgccgcgatcaccatcgggatcatgcaggacggtgccgcgggcagccagagcagcaccggcgggacatgccagccggccaggatggcggcgaagacgacgatggcgctcagcgccaacgcggtcgacgccagcaccgtgcgaggcatacgcctgatcacgggaaacctttcgtcgaaccgtcaatggtctgaccatcgcccgatcagcccggcacctgaggaatcgactgacgagcccgcccgtcgctggggcgcctgtacccgtccgggctacgcgctctccgggttgtctgccctccggtcaggttccgccgcctattcccggtctccgtgcccggtctccgtgcccggtctccgtgcccggtctccctgcctggtctccgtgcctggtctccgtgcccggtctccgtgcccggtctccctgcctggtctccgtgcctggtctccgtgcccggtccgcggtaatcggcgcccggtccggcgcccttcgaaccactatccgcggtgctcggtctgctcctctccgtgccgtcagccggggtgctcggtttgctgcccttcgtgccgccagccgcggtgctcggtctgctgcccctggtggccgcgggcgtaggttttcgtgcccggggcggggcggcccggcggggagtggtgggtggcgagcggccgctctagggtcggaggatggtaccggcgaggttcggggcggatcgggcgtggggcgagcgagccgcgcggccgctgcggatcctggccggcaacggcgcgcggccgagcaatgcggaactcgccgcgctgcgggccggcctgacgcgtcgggacgagccggcggccgccctggtccgggcggtgcgggagtccccggtgctgaccatcggcgacctgcaccggatcgtcgcggcggggcccgccgaggacctgccggagccgttcgccggcttcttcgcgacggtcgcgcggcggcccgactgggtcgacgacggcctgctggagcgcggggcgcaggcctgccgggcgttcgggatggacgccgggctggtgctcgcctacgggtcgctgctcggcggataccggaccggcgcggcgctcgaacccctggtccggaccgggcgcctgaccggcggcgagacgctgcggcggatcaaggagacgtcgctctggtggcggtcggtcaccgcaccgggcggccttgccccggacggcgccggtctcaaggcgaccctgcacgtacgcgtcttgcacgccctggtcaacgcccgcctggagaacgacccgacctgggatcacgccggccgtggtctgccgatcaaccagtacgatcaggcgagcacactcggcgtcttctccaccagcttcctgctccaccttcgcctcctcggtgtccgtgtgacccgcgccgacgcccgggccgtgatgcacctgtggtgttatgtcggctggctgctcggcgtcgacgagcagtggcttccgcacaccgaacgccagggccgccgccagctctaccacttcctctcccacgacccgcccccggacgcgaacagcgtcgccctggcccgggccctgatcgcgatgaccgacgacgtcacccacggctggcgccggaccttcgaacgtgaacgagccctctcggtcagctcctggcttctgggccgccacgccctgcgcgacctgggcctgccttaccgcccgccctggtacgccctgacgcgcgtcgccgccaacctcctgatcacgcacgtcctggcgcggctgcccggcggccgcacccgtctcctgacccgcgccgaacgccaggcccaggctcagttcgcccgctggggcgccgagctgcccgcctgacagctcctgctctgccgtgagcctgtcgggcgaggtcgttcggttgtcgcggccgcccgcccgaccggtgtcagatgatgcctccgttcgcgcgcagcgtctgaccgttgatccagtggccggccgggccggccaggaaggcgaccgcggccgcgatgtccgccggtgtgccgaggcgctccaggggcggctgctgggccagacggtcgatggtggcctggtccttgccctccaggaagaggtcggtggcggtggggccgggcgcgaccgcgttgaccgtgatgtcacggccgcgcagctcgcgggcgagaatcatggtcatcgcctcgacggcgcccttgctggccgcgtagccgccataggtggggaactgcaggccgagcacggacgtggagatcatcacgagggcgccaccggcgcggagacgacgggcggactcgcgggcgatcacgaaggcgccgcggatgttggtgcggtgcatccggtcgaggtcgtcgaggtccagctcggcgatgggggacaggtgcatgatgccggccgagttgaccaccacgtcgatgccgccgaacgcctgctcggccaagtcgaacatggcggcgaccgcggtttcgtcggcgacgtcggcaccggcggcgatcgcccggccaccggccgcggtgatctcgtcggccaccgcggcggcggccgcggcgttgccgctgtagccgacgaccaccgcggcgccgtcggcggcgagccgctgcgcgaccgcccggccgataccgcgcgacgcgccggtcacgatcgccactcgctgctgagacatgtgcgcactcctttgatagcgccgctatcgcttccccgtagcggcgataaaaagactgtatcaccgatacggcgacggcgtaccatcgcttccatgacctccgacgtccgcgccgcgctcatcgccgccaccgagcggctgctggccgactcgcccgaccacgacatcgccacccgggcggtctgcgactgggtcggcgtcacccagccggtgctctaccgcatcttcggtgacaagaaaggcctgctcgatgcggtcgccgacgatggcctgcggcgctacgcgcagcgcaaacagtcactggagccgaccggcgatccggtcgccgacctgcgcgccgggtgggacgaccacatgaccttcgcgcacgagaacccggcgatctaccagttgatgttctccccgcgaccccgctcgcacgcccgcgcccggcagaagatcatggaccttctacaggccaccctgacccggtgctcggcgatcggcgcgctccgggtcgctccgggcctggcggcgcagatgatcctgccggccaacgtcggtctcgccctgagcctgatcgcccagcccgagctcttcgacgatccgagcctgtccatccgcatgcgcgaggccgtcctcggcgcggtcctgaccgagccggccacgcacggcgaggaggcggatccggttccggccgcggcgttgaggttgcggtcgcaattgacagtctccggtacgcgtgttctggagcccgccgaggccgccctgctcgaccgctggctggagcgtctcagcacgtgacggggcccggcggtcgtgccggtgcgggccggcgggtccgggtggcggagctggaaccagggggagggatggtcgatggccggcaaggatgacggggctgcgcgatcgatgccccggacggcactatggcgggatgacggggagagacaacgacgtacgccgaccgtccggtttggtcaccggttcgctgatcgggctcagtttcggcacggtcttcgtgatggtgaacagtggcgatctgcccgatccctggccgacggtgatccgggcggccgccgtggtgaccgccgccgctctgctgttctggatgttccgggtggtccggtcggccgggtcggcggccgggagcgacgacgtgcaggggttcgcccaccgcgcatactggtatgcggtcgtcggcgaggtgatcgcgctcttcggcgggctgtatgtgatcaatcaggtgctggacaagccggacgtcgcggtcgcctgggtggcactggtggtcggggtgcacttcgccccgctggcgtgggcctggcggatgccgttctactactggctggccgccctcatggccgcactcggtctcggtggtctcctggcgtatgccgcgggcgcctcggccggcactgtcgccctgattgcgggtgtcggctcgggcttcgcgctgtacggcgccgtcgcggccggccttcggtacgctcagcggcgcgcggcttccatcgtctgaccgggtccgcgggtgccgcattcccgaccgagccggccaggttccgcgcgaccgcgtagacgtcgaaaccgccccctgctccggcgatcaacacgttatgggagccggacagggcggtcagcggcggtgggtccgcgagcaagaatgtcacagccccacggtacgaaggagggcagacggatccggcgtcgagaccccgggtgggcgaggcgctgggcttcgtcgattcgttgccggagctatgcggtacggtgctcggtcagagttcctgggggaggcgacgcgcatggtcgacatcggttgggtacgcaggatggacgcgatcaccggtggtgcgatcgtgctgaccgtcgatgccgtcatcttcctgatgaccgctctggtgggcgcgccgctgctgctgttcttcatggcggacgacgagggtgccgggccgctgtggccctacgcgaccgtgtggggtgtgtccgcggtgctgggtgccgggtccgcggcggtggcctacctgatcggcgatcggggcacccggggcatccggcagatcggcgcctcgatcgcgctgaccaccgcggtggcgaccggcgcgctggtggtgggcgcgatcgagtcctcgccggtcctggcgatggtcagtgcgctgttcgcggcggcgaacgtcggcgcggtgaagatgcttctcggcccggagccggtggaggccggtccgccggcgctgccgaacacgttcctgctcgcggctccgctcgcggaggccgagttccgcacccgggagaccgtcgagatccaggtccgcccggcgcccgcgatcgcatcgggggacacggaggcgcccgcgatcgtatcgggggacacggaggcgcccgcgatcgtatcgggggacacggaggcgcccgcgatcgtatcgggggacacggaggcgcccgcgatcgtatcggcggacacggaggcatccgcgaccgcatcggcggacaccgaatcggccgccggcgagcgccgggacgagaagaccggggccggcgagacgacccgcaccgagtcgcagaccggcttggcggcattcagcgggacgatcgacgccgggctggcggacgtcgacgcggcgggcggcgagtcggattcagaggtggctgaggccgagtcggtcgatgtcacatcaccggcacgacggatcgtcgggcgcgatccgcggatcaggccgcgaggctcggccgcgatgcacaccatgggcggcgtccgcctccctccgagagccacgcgccggcgaagctgagaaggagccgagcgcccggctcaatgccggagggctggcgagccgcggtgatgggcggcggtcagcggtggagggctgcgggccggtggttgtcgcggtgatgggcggcggtcagcggtggagggctgcgcgccagtggttgtcgcggtgatgggcggcggtcagcggtggaaggctgcgggccggtggttgtcgcggtgatgggcggcggtcagcggtggaggactgcgcgccagtggttctcgcggtcggtgggtggggtcaggatgcagtcgccgcaggtgccgccgccggggatgcggtaatacaggcagcagttgcggcgtaccaggaagcggcggtcgcgagccgggtcgggtcggaccaggtcggcggtggccctcaggggtgcgcggagcaggagggcttcgaggatctcggcggcccgggacgcgtgtggcggggactggtcggcgatcatcccggcggccccgccgagagccgaggccacatttccccacagcacctgcggggacagggagaaccgcgttcggaacgtttcgagcagcgggccggtcagccgggccaatgcggtctcggtgaagcgggcggcgatgaccgtcgcgggttcggtcgtgcagggcacggcgtcgacggcgcggtaggcgaccggcacaggaccgccgggcaccggccgccaccacaggcggtcgggctcaggcagcggcagggcgccggcgatcgatgcggcgccgagcagcggggacagcaggcgggaggccagccccagaaaggtgatcgaggcggtttcgcgttcgccgatggcgtccggggtgaggcctgacatccgtaccagggtgctccgcgcgatggctacccgctcggccgcaacgttgtggtccagcaggtcgcggaatggccgccagtccgcggcgtcgttcaccggctcccaacggaaatagggccccaatcgtccagcgacctccaaaacatccgcgccgtccaccatgcgtctcacgataggggtcgcgcctccacaaggctccagcggtgcgacgtgagacacccgccagcaggtctcccgcgcgaggaagacgcgacggaaacgggggaaggcgcgagggagacgggggaggcgcgagggagacgcgagggagaaaggtgagctacaccgggctgatgtggctgtgagcgagggcacgcccgcggcgtccgcccggttgctcagacctttccaccccaggtcgataacacagtcatgaaactggaggtacgacggctgtggccgatcttcgccgcattgaccgcgtgcgtcctcggctttctgctcctgcgccaggtcgcgaccagcgccttcgatggtctggaagcgcggcaggtggcccaggacgccgaccggatccggatcggcctggacaaccaggctcagctgctgaccgctttcggggtcacgaacagcatctgggacgaggcctacttcaccatcgcccggggcgacgaggccgctttcgatgtcgactatccgccggccagccagcatgacgacaacggcctggacggcgttctcggtgtttcggcggccgggaagctgctggtcggcggtctcaccgacggtggtgacaggtttaccgcactgcccgccgacctgaacgacccggcgctgctcaagcggctgtacgacccgaacgcccgggccggcaccccgacctgtggggtgctcgcggccggcggcggctacctcttctgtgggctgggcgcgttccgcagctccggcgagggcgccccgtcgggcggtttcatcatgctgaaacggctggacgccgcccggctggccggcctcggcaaggagctgagcctgagcatcggcctggtcggcggcgtccggccgggcgcggtcgcgcagccggcgctgtccagccggatgggcgccgtgcaggtgcacaccgcggtgctgggcaccgaccagatggcggtcgacgcgagcgtcgccacggtcgacggtggcagcctcaccatggaggcggtccagcctcgaccgatctatcaggcggcgacgcgtaccgcctggcggcttttcgccctgatggtcgtcgccaccctgctgctggtgctgttcatgcgctggtcgacgcgccgcgcgttgcgggtgcgggtgcggccgttgcgggagacgacggagcagatcatcgcgtcgggtgatcacacgttgcggatcaatgcgtccgggtcggacgatctggccgcgctgggccggacggtcgacggcatgctggaccggatcagtgcgaacgaggagttgctgcgcaccgagcaggagcagcggcagcaggagttgcagcgggcgcacgacgagcagaccgccgcccagtcggcggcgcagcgggccgcccgggagctggtctccggcacgtcgacggtggtcagcgcgcagctggcggacgtctcggagcgggccggttcggtgagtgccgcggccgcccggatcgagggtcaggtggcggatgtccgggaggtcgccggccggctgctgaccgggaacgccgaggcgacgggtgcgatcggcaccctgcacgcgagcctggcccaggtggacgaggtggcccggttcatcggcgggatcgccaagcagacgaatctgctggcattgaacgccacgatcgaggcggcccgggccggtgcggcgggcaagggtttcggggtggtggccgacgaggtgaagtcgctggcactgaccacggccgagtccacccggacgatctccaccacgctcgacgagctgaacgagcacgtcgccgcggtcgtggagatcatgtccgggatgagcgccgcgatcaccgacatcgacgcgaccacagcccgcgcccagtcgatgacggccgagcaggcgaccacgctgaccgcgctgaccggacaggtgtccgcggcgatcaggaagctggacgacctagcggttgctgactgagcggagcagctgctcgcagaaggccggcagatcatccggcttgcggctggtcaccagcgccccgtcgacgtggacctccgcgtccacccaggtcgctccggcgttggtgacatcggtccgcaagctgggccagctggtcagcgtccggccctcgacgacacccgcctcgaccagcgtccacggcccgtggcagatcgcggcgaccggcttgccggtcgccgcgaagtcgcggacgaagcggaccgcgtccgggtcggcgcgcaggaagtcggggttcgccaccccgccgggcagcaccagggcgtcgtagtcggtgacggcggcgtccttggccagccggtccaccgcgtacgtcccggccttgtccaggtggttgaccgcctggatcgcaccgtccttgatcgagatgagttcggcggtgccgccggcgttctccaccgccttgcgcggctcggtgtactcgacctcctccacaccgtcggtggcgaggaaggcgatgcgtttgccgtgaatgtcgatagccatgatggttcgtgtgcccgagcccgcttcgggtaaaccaggctcatgactgttccgacttgggtgaagacggcggccggggtggtggccgcggccggcgccggagtactggccaccgatccggattcgcggtggtaccggaggctgcgcaaaccttcctggcagccgcccccggcggcgttcccggccgtgtggaccccgctgtacgcgctgatcgccgtggccggggcccgcgcgatcgaccgggcggaagggtcggagcaggcggatctggtccgggcgtacgccgtcaatctggggctcaacgcggcctggagcggcttgttcttcggcgcgaagcggccgaaggcggcgctcgccgagatcctcgccctgaacgtgtccaacgtcgtactgctgcgtcgggcggcccgggcggaccggctggccggtgccgccctggccccctacgtggtctggacgatgttcgcgaccgccctgaacacggcgatcgtacggctgaacggaaacggctccggtgtcaggacacggtcaggttgacgtcgtcgaaccaggccgcgccggcgttgtccccggacttgaggtgcagctgcagcgcggcggcgtccggcggggcgatcgcgccgacgctcagccgggtccagtcggtggtgcccggcggcagccgcagcgagcggtcctggctgatccaccggccctgggcgtcgaaccagctcagggcgatctcggtggtgccggtcaggtcgagccccttggcccaggccgaggccgaccaggtctgcccgccgtgcaccggggtgagcggtgagatccgcagcgagggcagcccgcgcgggtcccgcccggtgccggagaaccgcaccgagtagatcccgtcgtgcgccgtctcgtcggtctgcgtcgccaccccggcgcccggcaggttgtcctgccacggcgagtcgtcgctgtcgcgttcgaagctcatgtccagcaggtcgtcgccgggcgtcgtgccgctccacgcgtcgcgcaccaccgcggccgccggctttgccgtgccgtcggcccggaacaggccgaaccggtactgcgccggctgtgcggaaacctgtgagccggccggtatcgcccccggggcgaaatcggtcagcgtccacggtgccaccgaacccacgccggcctcggcggcggcccggaacacccgggccagatagacggcctgcgcaccctggctgctgccggcggtgctcagcccggtctcgccgatcaccatcggatccggcgcgaccatctcctgtgcccgccggatctcggtcagcgcctgctcagacggcccgtagtagtggaagtcccagtagttcagcatgtcgtcgccgagcacgtccttgagccgggccagcccggacgggccggcgtgcccgtcgaccgacacggtcagcggcatcgacggcgcgaactcgcggatcgccgggatcacccgccgtgcccagccgatcgcctccgcgtcatccggtgacatctcgttcttcacctcgaccgcgatcacccgcgggtcgtccacatacggcgccaggaccgcgttcgcccaggtaacgctgccattgacactgctgtaccgggaccaccaatcgaacagcgtcaacttcacggtgaggcggtggaggccggccaggttgatgatgtcgctgagctcggccaggtagtcggggtccggctgcgggaagccgaacaccttcgggaacaccacgagccgcacggtggtcccgcccagtgccgcgatccgctccaggtcactgtccacctgaatcgggtcgaaacgggtccacatcgcggtccagccggccgcggacggatagtagttcatcgttttcgcggtgcgcaccgcgtccagccggcttcccagcgtcggcatatcaggatcggtcacggatgctcccgggttgccgtcctgaccggcgtcggccagcgccggcgccgctggaaccaaggcgccgacggtcaggaggcaggacagggcgagtgcgcgaatgcggtcactgctcatggggggacggcgtcctttcacgtcatcggtagtgcgatgtccgtttcgaccgggacgccggtacgccgagttcagagcggttgccgtccggcgtcaatcaggttcacaagacgattgcggcggtacgccgtgaagcccccgcccgggccgaccagtggtagtcgcccggtgcggccccggcggcgatcaccacggacgccgagctcacagccgcgctgcgggactcataccgtgaccccgggtccacgcagatcccgcagaacagcggcgccaggggtcacctgaaggtgccggcgctgttcgcctcgaccatctccgacttcgtcgacaatcaatctgacggcgatgggcgaggcgccgggcggtgcttcgcccctttgaagctcgccaacagttgagccgattccctggtcatcgtgtcgtcgatcccccgcgtccgctcgaagtgcttgttcacgcgttccagaatttcgatggactcgtcgatgcggccgaggtgggcatatgtgatggccagcgtcgataggcagtgcggcggagagcaggatcccgagtgcggcctcgacggcccgttccgcggtgccgtccgacgtggatgcctcccgaatgaccgcttggaccagccggtgcaccgtcaggcccccagcggccccggagaacccggggccgtggtcgacagtggtcgggggtgttgcccttctccacccggtcgacccggcgccgagggcgtcgcccggctgccggccggggccgccgccgaagtggggcgaccccgggagcaggggacggacaccggtccgaccccggccccgagtacgggatcaggtgttggcgccccgggcggccacccgccaccggtcgatcagctcgccgccggacgtcacgaccagctcgtcggccaggttgaccgtggcgcagacgtggttcgggacgacccagagccggtcgccgagtccgggaagcggggagtcgccggggaagagcaccgtggcgtggtgctcggagagggcggtgatccgggcctgcgggtggccgaggagccggccgccgccggtggcccaggcctgctggtcggcgccgagcaccttgctgccggcgtccaggatgatccggcgcccggagcgactgaccacggtggattccacggtcagggccacttcgtcccagccgcaggtgccgagttcgacctgctgggcgtcaccgaacacgtacaccccggggcgcatctcggtgagcggtccggcgccggtcagcgccgcggtcggggtggagccgccgctgcggacgccggcgtccagcccggcggccgccaccgcggcggccgcctcggtcagcgcgtccgcctcgtcccacacggccgccgccatccggcccggcccgtaggcgtgcccggggaaggtgaacactccgcggaccgtcagcccggcccggtcggcggccgccgcgatctccccggccgagccgggtgcgacaccgctgcggtgatgcccgctgtcgacctccaccaggacttccagcccgggcaccgcgcggccgagggccgccgcgctctccgccgagtcgacgccgatccgcagcgccacccgggcggcgagcgcgcgcagccggtcggcgcgctgcccggatggccagatcggataagcgatgaacaggtcgtccgccccgccgtcggcgaagatctcggcctcgctgacggtggccacggtgaggccgtcggcgccgagctcgagctggcggcgggcgatctcgacacacttgtgggtcttggcgtgcgggcgcagcggcagcccgcgaccggccatcgcgcgcaggttgcggtcgaggatctcggcgtcgacggcgacgtacggggtgggtggatcggcgggcaagacgacctccaaaaaaatgtggcgaaggggttggcactctctccgtggcagtgctaaaaaattatctgtcgctgctggtcagcgacctcggcagatccgatctacagccgagcgccacgtgtccgccggagagtccggcgggcagtcaagaggaggtgtcgtggtgctgactttcgatcccttccgggagttcgaccggatgatgggcgccggtgccgccggtctggcgatgccgatcgacctgtaccgctccggtgaccacttcatcctgcactgcgacctggccggcatcgacccgggctcggtccaggtggacgtcgaccggcgggtgctgaccatccgcgccgagcggtccgcgcgcaccgacgacgacgtgcagtgggtgcgccgggagcgcccgaccggcaccttcgagcgacggatcaccctcggtgacggcctggccctcgaccagatcagcgcgacctggcaggacggcgtgctcacgctgaccatcccggtcgccgaggcggccaagccgcgccgcatcccgatcagcaccggcgaccggcacgagtcgccggcaccggccctgaccgagtcatagttccgcgagccgcccgccgtcgagtcgcaaccggcgggtgatgccgatctcgtcgaggaagcgttcgtcgtggctgaccacgacgaacgctccccgataggcactgagcgcggcctccagctgcccgacgctgtccaggtcgagattgttggtcggctcgtcgagcaggagcagctgcggcgccggttcggcgaagagcacgcacgcaagcgtggcccgcagccgctcgccgccgctcagcgcccggaccggcaggtgcgcccgggcaccccggaacaggaagcgggccagcaggttcatccggtcggcgtcgggcagcgccggggcccacgcggccaggttctccgcgacggtgcgatcctgatcgagcaggtccaggcgctgcgacagatacgccacccggccgtcggcccgggtcagctcgccggcatccggccgctgatcaccggtgaggacacgcatcagggtggacttgccggcgccgttcgggccgatcagcgcgatccgttccgggccgcggatgtccagatcgacgccgggcgcggcgaacaccggcaccccgtcgtacgccacctgcagattttcgccgtggaagacggtgcgcccggccgggacggtggtgtccggcaactccacgacgatcctgtcgtcctgcttcgccgcgcgcgacgcctggtcgagacgggccctggcgtcgccgacccggttcgcgtgcgtctcgttcgccttcgccgccgacacctgcgcatcccgtttcaggccaccggccacgatccgggccagcccggcgtcgcccagggtgcgcgccgcggtcgacgcgcgccgcgcggcccgctcccgggcctgctgcatctcgcgtttctgccgtttgaggtcctgctcggcagtgcggacctggcgctcggcgacctcccgttcggatcggacggccgcggagtacgcggtgaagtccccgccataccaccggatctcaccgtggtcgagggccgcgatccggtccatcccgtcgagcagcgcccggtcgtgactgaccaccagcagcgtgccggaccagccgcgcagcaccgcggtgaggcggtcccgggccgggccgtccagattgttggtcggctcgtcgagcagcagcacgtcgggccgtttcagcagctgggcggcgagcccgagggagaccacctggccgccgctgagggtggccagccgccggcccagcccgatcccgccgagcccgagccggtccagctcggcgcgggtgcgctcctcgatgtcccagtcggtaccgacggtggtgaaatgctcctcggcggcatcgccggcctcgatggcgtgcagcgcggccaggatccggtcgaccccgagcacctcggcgacgctccgctccgcggcgaacggcagatgctgcggcagatagccgagcacgccgtcgaccacgacgctgccgccggtcggtcgcagctcgccgctgatcagccgcaacagggtgctcttgccggatccgttcgccgccaccagaccggtgcgcccgggcggcaccgcgagggtcagatcgtcgaagaccggggtgtcatccggccaggaaaaggacagattggtgcacgtcaaggacatgaaaggacctcagggggtacgaaggggtcacgctgatcacgacatgggggagcggggtgtcaccccgagatgtcgtcatccgctgacacgactgctccgttcctcgaccggcaccgagcttagctcgccccgaccgcggcctcatccgcataatgtccgcgggcggcggtcgcggcacggcgtacccacatgatcgccgtggtcctcatgcttctcgatcatcgaagcggagggtcggcggccggagccagcacgatgtcgaagcggacccggctccacgggcgatcaccgaggtcgcggccgtccggaaggcgatcgcggcgcgccactcgtcctcggtcagccgcacgtcgcggacgaaggcgtgcaggtgccgggtgagcgaccgcatcacctcgcgcagccgcgggtcgggagtgtccgcgaaggacgccaccacccggtcggtcaactcctgctcggcgtccataccccggaccttaacgccatccgatcccggtgcaccgggtcacgatctcggcgacctgccgcaccgcgggggaggtctccccggaacgggtggccagggccaggtcgatggtcggcgcctgatccagcggaaggtagacgacgccctccagggccaggctgcggaccgcctccgggacgagggcgacgccgaggcccgccgcgacgaagacgaccagggtggcggtctcgccgacctccatgatcgaggacgggcggaagccggcggcggcgcaggcggtgaggacgtgctcgtgcatggacgagcggtggccggagaagtgcatgacgaaggggtcgggggcgaggtcggacaggtggatgcggggctggtcggcaaggtcgtgccagtcggggaggacggcgaccagccgttcggtgcgcagcacccggatgtcggcgcccggggattccgtgcgcggcgtggtcgggttgtccgggcgcgtttccgtgcgcggcgtggtcaggctgtccgggcgcaggacgatgaggtcgtaggtgccgtccagcagaccgtcgagcagtgccgggctgagcagctcgccgtgcagctccaggcggacctccgggagcagacggcggacctcccgggcggccagcggcagcagctcgtacgtcgcggtgccgatgaagccgaccgacacccgtccggcctggccggaggcgaccatcgccatgtcggtggcggcccggtcgaccgaccccagcacggtccgggcgtgctcggcgaagcgcagcccggcctcggtcagctcgacccgccgggtggtgcggctgaccagctccaccccgaactcccgctccagctgcttgacctgctgggacagggccggctgggcgatgtgcaggcgctcggcggcccggccgaagtgccgctcctcggcgagcgcggcgaaggagcgcaggtgccggagttccatgcattcaggttatcaatcgtgcgtgattcagtattggcctcaatcggtgcgggcggcctaggttgagaggcatgaactccgcctacctgtacgccgcggcccggaccccgttcggccggttcggcggcgccctcgccgacgcccgtcccgacgatctcgccgcggccgccctgagcggcgtgctggccaaggcccccggcctggacccggccgggatcggcgacgtggtgtggggttgtgcgaaccaggccggcgaggacaaccgtaacgtcggccggatggccgtgctcctcgccggcctgcccgtctcggtgccggccaccacggtcaaccggctgtgcggctcctcgctggacgccgcgatcatcgcctcccggaccatcgagtccggcgacgccgacgtcgtggtggccggcggcgccgaatcgatgacccgggccccctgggtgctgcccaaaccgtccagagcgttcccggcgggcaacgtgaccgcggtgtccaccacgctcggctggcggctgatcaacgagcggatgccccaggagtggaccatctcgctgggcgagtgcaacgagcagctgggcgacaagttcggcatctcccgcgagcggcaggacgagttcgcggcccgctcgcaccgcctggccgacgccgcctgggccgccggcttctacgacgacctggtcgtcccgcaccccgctctcacccgcgacgagggcatccggcccggctcgtcggcggccaccctcgccgggctcaagccgtcgttccggccggacggcacgatcaccgcgggcaacgcgtcgccgctcaacgacggcgcctcggccgtgctgctcggctcccggtccgcggccgaccggatcggcgtcgccccgatcgcccggatcgccggccgcggcgtctccgcgatcgagccgaccctgttcggcttcgccccggtcgaggcggccgaccgggcgctcgcccgggccggcatcacctgggccgacgtcaccgcggtcgagctcaacgaggcgttcgcggtgcagtcgctggcctgcgtcgacgcctggggtgtcgacccagagatcgtcaacgccaagggcggtgcgatcgccatcggtcacccgctcggcgcctccggcggccggatcctgggtacgctcgccgcccgcctgcgcgagtccggcggccgctacggcgtggcggccatctgcatcggcgtcggccaggccctcgccgtcgtcctggagaacgtcgcgtgaccgcccggatcgtcgcgaccgccgccgaagcggtcgccggcatcgcggacggctccaccgtgctgatcggcgggttcgggatggccggcatgccggtgcacctgatcgacgcgctgatcgagcagggcgccaccgacctcaccgtggtctccaacaacgccggcaacggcgacaccgggctggccgcgctgctggccaagggccgggtccgcaagatgatctgctcgttcccgcggcagtccgactcgtgggtgttcgacgggctctaccgggccggcagaatcgagctcgaggtggtgccgcagggcaacctcgccgagcggatgcgggcggccggcgccgggatcggggcgttctactgcccgaccggggtcggtaccccgctcgccgagggcaaggagacccgggagatcgacggccggacccacgtcctggagttcccgatcaagggggatgtcgcgctgatcggggcgtaccgctccgaccggatgggcaacctggtgtaccgcaagaccgcccgcaacttcgggccggtgatggcgaccgcggcgacactggtcatcgcccaggtccgcgaggtggtcgacaccgggcggctcgacccggaagtgatcgtgaccccgagcatctacgtcgaccgggtggtggcggtatgagtctcgacaagcacgagatggccgccctggtcgcccgcgacatcgagcccggctcgttcgtcaacctgggtatcgggcagcccaccctggtcgccgaccacctgccccccgaggcgggcgtggtgctgcacaccgagaacgggatgctcaacatgggcccggccgccaccggcgaccggatcgacccggagctcaccaacgccggcaaggtaccggtgaccgagctgcccggctcggcgtatttccaccacgcggactcgttcgcgatgatgcgcggcgggcacctcgacgtctgcgtgctcggcgcgttccaagtgtcggcccgcggcgacctggcgaactggcacaccggcgaggccgacgcgatcccggcggtcggcggggcgatggatctcgcggtcggggcgaaaagcgtctacgtgatgatgacgctgttcgccaaggacgcaagcccgaaactggtgcccgactgcacgtacccgttgaccgggctggcctgtgtcgaccgggtctacaccgatctggccaccttcgcgatcaccccggccggtgtggtcgtccgggagaccttcgggatcaccttcgacgagctggccggtcggctgacgattccgttgctcaggatgtcctcatcggagtgagctccggttacgctgctgatcatgcggctgggcgtgaaccttccacagaccgaccggtacgacctggcgcgggacgtgaccgtgttcgcccgggccgcggaggagatcggctacgacagcctgtgggcgtatgagcggatcctcgccccggtcgacaccagcgggccgcacgggctctacggggtgcccgacctgccgtggccgccgagctactcgcacaccaccgacgcactggtcaccttgagtctcgcggccgccgtgaccagccgggtcgagctcggcaccagcgtgctcgtgcccgggttgcacctgccgttccggctggcccgcagcatcgccgcgctcgacacggcatccggcggacgggtcatcgccgggctcggcagcggctggtcgatcgacgagttcgcggctaccgcaccccggccgatcgaggagcgcggggcggcgctcgacgaattcctcgacatcgcggccgcggtgtgggggcccgacccggtgtcgtacgcgaccgaccggtaccggctcgcgccgagccgggtcaacccgaaaccggcgcggcgggtgccgatctacctggccggcggcaaccggaccgccctcagccggatcgcccgccgcggcgacgggtggctgcccaccggggtgccgccacagcaggtcgggcggatcctgggtgaactgcgggccgaggcggcggccggtgggcgtgatccggagtcgctgacctgcatcttccagctcggggtgcgcgggctcgccgaggcgccggacgaggggcgccagccgtacacgggcagcctgcgccagatcgtcacggacatcgcggccctggaggaggccggagtggatcatgtcttggtgacgctggcttcggtcgccggtgacctcaaggaactgatcgccctcgccgagaccctgcaccgcgaggcgcgcgccgccggcctctgaccacgccggcccatccgccgcggctcagcgggttcgcggtcgcggtcacgccggcggcggagaggtgtccgatgacggcgttcccgctggccgatccggcgaaggcgccgtggaccgggacgacgatcggctcggacatgatcggctcctgcggtaggcggtgggatcgttcccgcttctccggcagtttctccgggagagcgccccgggcggacccgggaggatcactggtccccccgggcagacccgggaggatcactggtccccccgggggcctggcccgcttccgtggaacgcctcggcctcagggggtggggagcgcctcccggcggcggaccgcccgccgcagcggttccaggcgggcgcgcaacccggccagcccgcccggcacgaagtagacggccaggatgaacaggatgccgagcacgaacagcggctcaccgagtggcccgggcagccgcccgcccagccgggccagacgctggtcgaggtacgcgtacaggatgccgccggcgagcgcgccccatctcgtccccgctccgccgagcaccgccatcacgatcagcgtcagggtgaggtcgcaggacgccacgtgtggcgacgcacccgccgtgaccagggcgtacaccaccccgcccaggcccgccagtgcacccgcgacaacgaaggcgacaagcttgacccggtacgggtcgagcccgaccaccgcgatccggcgctcgtcgtcgcgcagcccggtcagcgtccgtcccagcggtgcccgatcgatggcgtgcaccaccaggacgaccacgatcagggacgccagcgccagccagtacaggttgaccgtgttgctcaccccgaccagccggtccggcagtcccgccgtccgcatcggcagaccctcctcgccgccggtcagcccacccggatcccggttgaccaggatgtggcccacctcggcgaaggccagcgtcaccatggagaaggcgatgccggaggtacgcagcgccaccgagccgagcagcccggcgagcaccgccgcggccgccacggtcaccgccgccgcgccccacagcgaccagccgtagtggccgatcaggatgtcgacgccgtacgcgccggccgcgatgaagagggcgtggccgaacgacagcagcccggcccggccgaacagcaggtcgtagccgagcgccagcccgccgaagaccaggcagacggcgagcagctgcagcgtgccgggggagttgagcggcccctcgaagaggccgggcagcgagatcgccgagtacggcagtgccgcggcgagcagtagcaggacgagcggaacgtatctcttcacgcggccaccgccgtcccggcgatcccggccgggcggatcagcaacacgatggcgagcagggccaccacgctgacgtcgccggccccggccgcgccgtagtagttcacgaactgctggagcaggccgaccccgaccgcggcgaccgccgaaccgttgatcgagccgaggccgccgatcaccaccacgatgaacgcgaagatcagcagcgaggcgccctggccgggggagaccgcggtgaagtacatcccgccgaggatcccggccagcccggcgagcgccccgccgatcgcgaagaccagggtgaacgcgatgcgcacgtcgatgccgagggcccggaccatggcccggttctcgacgccggcccggatgatcagcccgtaccgggtgtaccggaggaacatggtgagcgcgatcacgaccagcacggccgcgccgatcagcaggaaccggtcgttcggcacggtcgcgccgagcaccccggtgacgtgcgcggcccacgccgggcgggggaacacccgggcgtcggcgccccacaccgactgcaacagcgccaccccggccagcgacaggccggcggtgaccagcacctgctcggtgtgccgggtgtagagcggccggatcatcagcagctcgaccagggccccggtggcggcggccacggcgatgccgaagaccaccgcggccggcagcccccagtgcggggcggcccaccaggtggcgtacgcgccggccgacaggaacaggccgtgcgcgaagttcaggaccccggccaggccgaagaccagggacagaccggaggcgatcaggaagtacagggccgcgagaccgagcccggtcagggtcagcaggaccacggtggacatgtcagcgactccccgcggtggtgccgacgcccagcagcgacttcgtcgccgcggcgtcgccgagcaggtcggtggccggcccgcgccaggcgacccggccggcttcgagcaccacggcgtcgccggccagcctgcggaccacggcgaggttctgttcgacgagcagcaccggtacgcgttcggccacccgtgccagcacggtcgccaccgcggtgaccaccgccggggccagacccttggtgggttcgtcgaccagcagcagccggttcgggttcagcagcacccgggcgatcgccaccatctgctgctggccgccggagagcgtgccggcacgctgcgcggcccgctgttccagctccgggaacaggtcgtggaccagagggtagtccggctccggggtgcgctcggcgagtcgcaggttctccgccacggtcagcccggcgaagacacagcggtcctccgggatgtagccgagcccgtcccggaccagccggtgggtggcccggcccaggatcggcttgccgtcgaccgcgaccgcaccctcggccggcacctcgcccaggatcgcgcgcagcgtggtggtcttgcccaccccgttgcgcccgagcagggcggtcaccccggtcggcgccacgtcgaaggtgacgccctgcaggatgtgcgagccgccgaggcgtaccgacaggtcggcgacccgcaggatcggcgtgctcaccggccctccccgagatatgcccgctggacgaacgggtcggccatcaccgcggccggggtgtcgcaggccagcagcgcgccgtggtgcagcacggccacccggtccgccaggtcgagcaccacgtccatgtggtgttccaccatgagcacgctgcggccggtgccggcggtcagcccgcggatcacctcgaccagggtcggtacgtcctcggtgctgaccccggccatcggctcgtcgagcagcagcacggccgggtcgccggcgagcagcagagcgatctccagcttgcgtttctcgccgtgcgccagggagccggcgatgcgatcggcgcggtgctcaagacgtacctccgccattatctcggcagcgcggaccgcgatgtcgcggtcggcgcggtgacgccaggcccgcatcgcgccaccgcgccgcgcctgcaccgcgagcgcgacgttctcggtgaccgacagcgttccgaagacggccgaggtctggaaggtgcggcccaggccgagccgggcccggccgtgcgcagccagcgcggtcaggtcgcggctgccgagcaggatccggccggagctgggccggcgcaggccgctgatcaggttgaacagcgacgtcttgccggcgccgttcgggccgatcagggcgacgaactcgtccggcgccaggtgcagggacacgtcgtcgacgatcggcacggcgccgatccgccacgacacgtcctcgacggtgagggccgtcatcgtcggtctcagcccttcatcgcggccgccggcggggcggtgtccgcggcggagacggtgccggtcagcgtcgcggtggccgcgtccccggcgccggtcagccgggcctggaacatcggctgcagcagcgcgtggtccgcggcgcggacggtcagcctgcccttcaccgagtcgaagctgtagccctccagcgcgccgatcatcttggcggtgtcgtccgggctggcctgcagcgcgtgcacgatcatctgcgcggcggcgaagccgtccgggtggaacaggtcggtccggccgcccggcaccgcggccttgagtgcctggtaggcggggttgtcggtggccccgtcgaagtagtgcgccagcaggttcagcttgctcgcgccggccccgaaaccggcccagccggcccggaggtccaggccggtgaccaccttggtggaagcgagcacgccctgctggtcgagcgcctgccacatggcgcccgccgtggtaccggcccaggccacgaagaccaggtcgggctcggcggccttgatctggctggcgaacggggtgaagtcggtggcgccggccgggacggcgatggtggagacggtcgcgccggccccgccgagcaccctggtgaccgcgtccacgttcgacttgccgaacgccgtgtcgggtgcgaagaccagcaccttcctgccgtcgccgaggtacgccctggcggtcagcacgtcctggtacgactgccggccggaccggaaggtgtacctgttcgcgccggtcacgccgtccgaggcggccggaccggagacgaacagcaccctgttctcggcggcgatcggggcgacctgcagcgccaccccggaggaggtggacccggccagcacccggtaccccttgccgatcaggtccttggccgccgacaccgccttgaccgggtcgcccgcgtcgtcggtgtaggtcacggtgatcgtcttgtcaccgaccttgccggtgttgtcggtggcgtacgcgagacccgccttgaaaccctccacatactgcgcgccgtagctggccagcggcccggactgggagtagaccacgcccacgttgatcgaggagccgttgccggccgcgtctttcgggctgccgcacgcgctcgtggtgaccacgacggcggacagcacggcggcgccgagcacggcacgccgggatgtcgacaaagaccgcatcggaatcagatgccttccgtcaagaggctgtttcgtgtggggcacacgctaagagctggtgggtggcctgggtcaccgtgcgccatcacatgggtgtcgcggtccttgtgtggctcgtccacatattcgcggtcgtcgctgatccgtacggtcaccggcatgacgacggcacgtgtggtcgacctcgacctgacaggacggaccgcgctggtcaccggcgcgggcagcggcatcgggcgggcctgtgccgaacggctggccgcggccggggccgaggtgcttgcggtggacatcgacgagcgtgcggccaaggagaccgcgacgtcgaccggcgggcgggcactggccgccgacctgtccgacccggacgccgtcgacacgctgccgggcgcggtggacgtgctggtcaacaacgcgggcctgcaggtggtggcaccgctgccggagttcccgccggacaagttcacgttgatccagcgggtcatggtggaggccccgttccggctcatcaggctggtgcttccgcacatgtacgaccgcggctgggggcggatcgtcaacatctcctcggtgcacgggctggtggcgtcgccgtacaaggccgcctacgtgaccgccaagcacggtctcgaggggctgtcgaaggtgaccgcgctggagggcgccgcgcacggggtcacctcgaactgcgtgaacccggccttcgtccgcaccccgctggtcgaccggcagatcgccgaccaggcgctggccaacggcatcccggaggcggacgtggtcgagaagatcatgctggaccgggcggcgatcaagaagctgatcgagccggaccaggtggccgaggtgctggcgtatctgtgcagtcccccggccgccttcatcaccgggtcgtcgatcatcatcgacggcggctggaccgcgcactgatcagggagactcatggacgaggtcgacatcccggtagccggcggcgccctgcgggcggtgagctggccgggcgacgggccgctggtgatcgcggcgcacgggatcaccgccaacgcgctgtcctgggcggcggtcgcccgtgccctggggggcaaggtgcacctggtggcgcccgatctgcgaggccgggggttcagcgcgcagctgcccgggccgtacgggatggatacccatgccgacgacctcgtggcgatcgccgactatttcgggatttctcgggtgccgctggtcgggcattcgatgggcgggttcgtggtcgccgcgactgccgggaaacatcccgagcgggtgggtccggtgctgctcgtggatggtgggattgctctgggtgtgccggccgccatcgacgtcgacgtggccctggaggcggtgatcggcccggctatgcgacgactttccatgaatttcgactctgaagattcttacgtcgcttatttccgggcaaatccggcattgggtcgctactggagcgcggacctggaagcgtacattctgcgcgacttcaccggcaccggctccacctgcaacctcgcggcggtccgcggcgacgccgccgacatgctccgcaacccgcgcccggccccgttccccctgctctgggccccgcgcggactggccgacgaggacaccggcctctaccgcgccgaccagctcaccggcgtcgacgccgaacccgtcccggacgtcaaccactacacgatcctcaccgccggcgccggccatgtcgcctcacgcctgctcgccctgctctgacccacgacgcaggccgcggatcgggcggatcgccagcagcagcgccaccaccaccagcgtgaccagcgtggcgagcagcatcaggtcccggggtggcaccacggtggtgagcgggccggccagcgcctgcccgaccgccaccccggacaccgacccggccatctcgtacgcggtgacccggttcagcacctccccgggcacccgggtctgcacactggtcgaccacatcaccgaccagaacgcccaggccgcgccgccgatcaggtgcccggcggccaggaccggcagcggcggggtcagcgccaccgagaacgggatcgcggcgaatccgatcagcgcgaccgccccggcggcgagcggccggcgcggacgcagccggatcgcggcgagaccgcccagcacggtgccggcgcccagggcggccatcgtcgtgccgtacgccgcgtcgcccagccgcccgccgaccagctgcgcggcgagcgggatgtacgggccgaagacgagcagcccgaacagcatccagatcaggatcaccgaccacatccagatgcgggaccggaactcggtccagccgtgccgcaggtcgcgcagcagggtggcggacccgcgggcggccaccggggagatccggatcagggccaggcagagcccgctgatcacgaaggtggcggcgtccaccgcgtagaccggggccgccccggcgaccgcggtcaggatgccggccagcaccgggccgcccagctgggtggcggcgtcggcgaccttcagggtggcattggcccgctgcggatcccgggcgatcagcggcaccatgccgttgaccccgggctggaacatggccgccgacaccccggacaccgcggacgcggccagcagcagccacagcggcggcgtcccggtcaggaaggcgaccgcgaccacgccctggctgaccgcgcgcaccgcgtccgcgccgatcatcatggtccgtgcgccgatccggtcggcgaacaccccgccgaccacgatgaacagcacgaacggcgcggtgaagacggccagcacatagccgacaccggccaccccgtacagcgcgccgaccgcgagcgcggccgccaccggcatcatcgcgtcaccgagcagcgacaccgcccgcgcggtgaagtacagccggaagtccctggtccacagcgccggcggagcgctggtcacgcacaaatccatgatcaggatcctggtcggcgggggtggggcggcgcaggggccgggcccgccaacattgagtacattcacgccatgccgcatcgtgtcgttgccttggtggggccggtgctggagctgttcccggtgaccgccgccgccgcggtgttcggcgaccacgggcccgacctcccgcggcactactcgttccggatgtgcgccgagcggcccggcccgatccccaccacgctgggcaccgagatcgtcgtcccggacgggttggcggcgctggacgacgccggcaccgtgctgatcgccggctggaccccgggcccgcacttctccgccgagctgggcgacgcggtgctggccgcgcacgcccgcggcgcccggatcgtcgcggtgagctgcgccgtctacatcccggcccggctcggcctgctcgacggccggcgcgcctcggtccactgggagtgcaccgacgacctggcccggcgctacccgcagctgttcgcggacgggtcgatcctctacaccgaccacggtgacgtcgccacggccggagcgaccgcggccaccgtcgacctgtgcctcgcccaggtcggccgggagcacggcgcgggcctggcgatccggatcgcccggcagctctccgccggcccgccgcgcaccggctgccagcgtcagggccccgccccggcgtcgcccggcccggcgccggattcgctggccccgctgctcgactgggtggtggccaacctcgaccggccgctcaccgtccgggacatggcggcccgctccgggatgtccgagcgcacggtgacccggcacttcctggagcagctcggcgtcccgcccgggcggtggctgctcgaccagcggatcgcctcgacccgggcgctgctggaggagaccgacctgccggtcgagacgatcgccacccgggtcggcctctcctcggcggtgaacctgcgccggcgcttccggaacgccctggcgaccaccccggcggcgtaccgccgcatgttccggacccgggtgtgacaccccggatgtttccgcggcacgggatacgccccggggcggacgccgcaccggcccgcccggcggaagatcggggtcatgccccaccggcgcaccaccctgctgttgccggccgcgatcatcttcggtctcgtgctcgcgttgccgtacctgagcctggacccggcccgcagccggatcccggtccccggcgacctgccgtacgcggtcctggtggcgcacatcctcaccgccacggtcgcgctcgtgatcggcccgctgcagttcgcccggcggatccgggcgcaccggacgctcggccggatctatctgctcgccggggtgctgccggccgcggtcaccgcgatcccggtcgcgctctggttcggccgcccgctcacccgggtcagcctggtcaccgcggcgatcctgatccgccgcaccccgacgcccaggacgggaagtccccgatgaccacggttctcctcatccacggcggcctcggcgaggacatgaacgccgaccgcttctggcaccggcccggcgtcgtcaccgccctgcgacgccacggcgtcgacgtcgtcgcccccgaccgcctccgccggccgaccgactggaccgccgaggccgaccacctgaccaccctgctgcccggccacccggtcaccgtcgtcgccggctccaacggctgctccgccgccgtccgcctcgccctcgccgccccgggccgcgtcgcacggctcctgctggcctggcccgcgacggccggtgacccccgggtcgaccaccatgaccgccgcggcctcaccgaccgcggcacggacccggccgtcatcgacagcatgctgaccggtcagaccctccgcggcgtcaccgacgacgagctcgcggccgtcaccgcgccggtcggcgtgctggcgtcgatccccgccaatccgttccaccagcgccgcacggtcgacgccctgatggtcatcctgccgacggcagtcgaactgcccggctgcccggaaccaccccacccggccttccccgcccacgccggccgcttcgtccacaccgtcgtcgagttcggcaacctttcgggagccgcgcggagctgatgccgagagcgtccccgggccgtcgccgatcagcccggcagcagggaacggcaggtcggcaggatcgcgtcggcgagcgctcggtgtccgtcgtcgttgggatgcgagcggtcgtcgcagagcaggtcgtagttgtagtcgatggcctgcgggaaggtgtcgaagtagggcagaccgagacgcttcgcggtgtcggcgatccagctgttgatcaggatggcgcgctcggaaaggtcgagacccgtgtagtacacgacgacgaggatcggccggccgggaagctcgtcgcgcagccgggtcaggtcgcggtcgatggcggcgcggacctcgtcggcgtgctcggggagcatgcggatgtcgttggcggccaggcacacgatgacggcgtccgggtcgagacggatggcggcgtcgaggagcgtcgtgtcggtggccgacggcaggtaccggtcgtcgccgccgcgcgggccgcggcggcggaagtagcccatgccgtcgatcgacaggttcacctcgcgccagccgagctcgtcgctgaccaggctggaccaccgggcgcgcgggtgtgtggtgccgcgccagccggtgacgatcgagtcgccgtagaagacgacggtgggatggttcagcgcgtgcggggaagtggccacgcccgatggtatcgatgcgggtggtcccgggaccgggggccggcacccgcgtgccggccccgcgggtgacccgtcagctcagggtgaacttctgcgccgcgctgccgttgcagtcccagatctgcaggcgggtgccgttcgcggtggtgccgttcggggcgtccaggcagcggcccgactgcgggttgcgcagggagccgtcggcctgctgctgccagacctggccgccgacgccgttgcagtcccagagttcgaccggggtgccgttggcggtgccgttgccgttgatgtccaggcagcggcccagggtgcgcagggcgccgttcgactggtggaaccagtgctggtcgacggcgtacgactggcagtcccagatctggaccgcggtgccgttgccgccggtgtcgtcgccgccgacgtcggtgcacttgccgcccggggtgccgaccacgccgccggcgttgaccgcgaacttctgtgcggccgcgccgttgcagtcccacagttgcaggcgggtgccgttggcggtggtgccgttcggcgagtcgacgcagcggccggactgcgggttgcgcagcgagccgtcggcctgctggacgaacttctgcgcgccgccgccgttgcagtcccagagttgcagcggcgtgccgttggcggtgccgttgccggtggcgtccaggcagcggttcagggtgcgcagcgagttgtcggcgaagtgcgtccagcgctgatcctccgagaaggactggcagtcccagatctggaccgcggcgccgttggcgccggtgtcgtcggccgacacgtcggtgcacttgccgccggggccggtgacggtgccggccgggccgttcgggatggtggtctgcccggcgtagccgacgccgaccacgttggcctgcaccgcgttctcggccgcgtcggtcgggtaaccggcgaccatcgcgccctcgaaccaggtgccccggttgcggttgctgttgtcgccgccgatgcccaggatgatcccgccctcctggtgcatcgggcggtaaccctgcttgtcggtcggcagcccgccgttgaaccaggtggtcaggcctccggactgggagttcccgcccttcagcgcgtacgtcgtctggccgttgttcttcagcaccgcggtgacgaaggccgagttgttgcccgggttcgggttggccccgttcccgccctggaacatgccgttctccatgtccgcctcgatccacggaccggaaccctggcacggcgcgaagtagcaggtggtggcgatgctgaccgcgtccatgtgtccgttgccggtgtcgtacggggtggactccgcgttgccgtagtcgaagcagcagtcggagcccacgtgggtgccgctggccaccatgtacacgccctcgggctgaccgttgacggccaccccggacgcgacgccgttgtagcggtagcccacgccgggggagacccagatgccgtacaccttgtggccgcccgcggtcaccgcgatctcgctcgcgtcggcgccccggtcgccgctgccggccccgccgtccggcgcgatctgcaggtcgttgtgccggctggtctggtcccagatgtgggtgacccggcaggtcgtgccgttgcagaaggcgtcctggtcggcggcgtcggcgtagccgccggcggcgagcgtcccgatgtcgtgggtggcgccgtcggaggcccgggtcacctggtagagccggccgctgtaggcgccgaacagggcgcgggtgacgctgtgcgcggcgacgcacggcgtgcccgcggcggcatagaggtcgcacggcagcgaggctgccgcgatggccgggccgggcgccgcgagaagtccggcgacgaggctgaccgcggcggcgacgagcagtccgagagagcgttttctgcgcatggtgaagtgctcctaggggaaggaggacgggagcgatgcgcgtcgaccgtggtcgattcatcgatgtgtcgaaaattacgcgcgctggtcgaacgagtcaatatgcggtaacaaatgtgcgatcctgttcgatcatcccggtacagatgcccgcgtcgcccgatcttcccgattgttctacgatcgtggcgtgaccgacgagtggggtgtgcggctggccggggatcgggccctgctcgatcgggggagcacggcggagcgggtcgccgacatcctgcggcagcggatcaccgagggcgtcttcctgcccggcacccggctcagcgaggagagcctgcgcgaggcgctcggcatctcacggaacacgctgcgcgaggcgttccggctgctggcccacgaggggctgctggagcaccaactcaaccgcggggtgttcgtgcggctgctgagcaccggcgacatccgggacctctacgcgatccgccggattctggagtgcggggcgctgcgcaacctgggtgcggtgccgccggaggcggtggccgcggcgcgggacgcgatcgaggcggccgaggcggccgccgagcgcggggagtggggtgcggtcggcaccgcgaacatgcgctttcaccaggcgatcgccgacctggccggcagccggcgggtggccgaggcggtccgcgggctgctggccgagttgcggttggtcttcctggtggtcgccgacccgcggcagctgcacgaaccgtacctggtgggcaaccgcgcgctgtacgaactgctcgccgccggtgacgcgcgtgccgccgaggaggcgttgcagcgctacttcgacgaggcggaggggcagctgctggccgcctacgaggccgccaactgagcggcgcgaccggggccggtcaggccggccggaaccggaccgcggtgcccgggcgggcctgaccgagcaggtcgacgtcggccgggtcgaccacgccgatcaccggatagccgccggtggtcggatggtcggccaggaagaccagtggctgcccgttcgccggcacctggatcgcgccgaggaccaggccctcgctgggcagttcgccgcggacggcccgcgccagcccggggccggccaaccgcacccccacccgatcgctgtcggccgccacccgatattccgccgagcccagcgtccggaccgcggccggggtgaaccagtcgtcccgcggtcccggccacacccgcagtcgcagctcaacgggcggcgggggatagggcgccacatccacgccgggcggcatgccccgggtctccccgagcggcagcacgtcgccgtcccggatctgctccggtcccagcccggacagggtgtcggtcgaccggctccccagcacgggcggcaccgcgatccccccgccgaccgccagatagacccgcaaccccgcccacggttgtccgatgctgatcacagctccagccggcaccgcgatcggcagcccgggatccgccgcgcgctcaccggcccgcaccgcgcacggcgccccggtcaccgccaccgtcgtcgcccgcgtcgcccgcagccgcacgccgcccagcaggatctccaacccggccgccccggccggattgccgacgagccggttggccagccgcagcgctccgccgtcgaccgcccccgagcgcggcaccccgagatgcgcataccccggcctgcccagatcctggatcgtcgtgcgcatccccgcccggaccacctccagtgccccggtcacgcggccaccacgaatcggacggtcgccccgggcgtgagcagcgccggcggctcattctccagatcgaacaggacggcggcggtacgcccgatgcactgccacccgccgggcgaagcccccggatacaccccgctgtacgcccccgcgagcgcgaccgtgccggccggcacccgggtccgcggtgtcgcccgccggggcacgtggtgctcgggcccgagcccggtgaggtaggcgaagccgggcgcgaagccgcagaacgccacgcggaacgcggtgccggtgtgcacggccaccacccccgcccggtcggtgccccaccactgcgcgacgtcgtcgaggtcggctccgtcgtacacggtcggaatctcgatgacccgcgacgggccggtggcgggcggcggcgcggtggtggcctcggtcagcagtgtcctgatctgatcagtgccggcgacgccgtcgacgagcacggtccgggccgccgggacgatctccgtggcccgcagccgcccctgtttccgggcggcgtcgagcagccggtaggcggcggcgaccccggacccgtcggcccactcgatgagcacggccgagggcccggcccggaatatgcgcatggtgccaatgcctcacattgaagtattgccggattgttcaacgattcctagagtgtgccacacgacaacggacaggagctcgccatgatcgccagtcgacgtgtcatcctcgccagcctgatcggcacctccctcgagtggtacgacttcttcctgtacgcctcggccgccgccctcgtcttcggcagattgttctttcccggattcgagccgctcaccggcaccctgctggcgttcgccacctacgcggtcggcttcgtggcccgcccgctcggcgggatcctgttcggacatttcggcgaccgcaccggccgcaagggcgtgctggtcgccacgctgctgctgatgggcggcgccaccttcctgatcggcgcgctgccgacgcacgccacgatcggcgcggccgccccgatcctgctggtcaccctgcgattcctgcaggggctcgggctgggcggcgagtgggccggcgcggtggtgatgtccctggaacacggcgacccgcggcgccgcgggttgtccgcgtcgtggccgcaggtcggcgtcccggccggcaacctgctcgccgcgggcgtcctgtgggtgctgtccgcgaccctgtcggaggcggcctttctcagctgggggtggcgtgtcccatttcttctttctggcgtgcttgtgctggtgggcctatggatccggggcacggtcacggagtcgccggcgtttgcggaactcgctgcggagggtggccgggcgcgactcccgctgatcgaggtgctgcgccgtcacccgcgcggcctgctggtcgcgatggccgcgcggatcggcaccgacgtcgcgttctacaccttctcgctgtacgtgctgacctatgtgaccggcaccgtgggccgcccgcgcacggtcgcgctgaccggcgtgctggtcgcctccggtctgcagctggggctgatcccgttcttcggcgggctctccgaccggctcggccgccgccccgtctacgccgccggggcggtcgccgccgggatctgggcgttcgccttcttcccgctgctggacaccgggaacaccgtggtcatcgtgctggcggtggtggtcgcgctggccgcgcacgccgccatgtacggcccgcaggcggcgttcgtggccgagctgttcgccacccggttgcgctactccggcgcgtcgatgggctatcagatcgccggcatcctgggcggcgcgctcgccccgatcatcgcgatcaagctggtcgcgtcgaccggcggcgcgctcgcggtcagcgcctacgtcgcgggggcgttgctgctcacgctggtggcgctggcgttcgcgccggagacgtcccgggacaccgggaccagcgcgccgctctccatcgccacccacacctgatcggagcagacccagagaccgtgtggctccgcgccgggcaggcggtggcgggtgatctcgccggacgcggtcacccgggccagctcggtcgacccccacagggtgacccagcagccgccggccgggtcgggggcgatcgcgtgcgggcggcaggccggatccgggaaccggaactcgtcgatcgctcccgacggggcgacccgaccggccaggccgcgggcgatgtcggcgaaccagacgccgtccggggcggcggtgataccgaccggggcgctgccctcggggagccgcaccagctccacggtgtcgcccggacggaccacggcgagcgcctcggcgccgttgagggcggcccacggcgtacccccgcggtccgtcgtgatcattgcgggccgggcgccggacagcggtaggtcgatcatggtgatcgtgccgccgcggaggcggccgatccggtcgctgccggccgcggtgaaccacaccgtgccgtccggcgcgaccgcgatgccgtagggggacgagccggccggcgtcgcgaacgtggtgtgcgtgccggacggatcgcggcggccgatccggtcgtcggagcgcgtgtaccagagcgtgttccggtcggcggcgagcagcatcgggcgcccgtcgaggggctcgagctccgggtcgccggcgacccggaccaggccggcgggcttcagcagcgtggtccagacggtgccgtcggcgtcgccggtcaccgcgtacggcgtccagcctgagggaagtgcgggcatctcggctcctctcccggaactaacacgacagttgtagcattagtgcatggcggacgctacccagatccccggcgcggcccgacccggcggccgcaccgcccgcacccggcgacaggtcctcgacgcggtcgcggcgatcctgctggagcacggcttcgacggcctcaccatggacgccgtcgccgagcgttccggcgtgcaccgggcgacggtctaccgccgctggcgtgaccccggcggcctgctcgccgacaccgtcgatgccgcgcgcgagctgccctgggagccgccggacaccggctcgctgctcggcgacctgaccgcgatcaaccgggaggtggtcgccgcgctgaccgcccggccgtcgatcgcccaggcgctgatcgccgcctcgttccggtcgccggccgcggcccgggcgctgcgcgacttctgggccgaccggtacgcccgggccaccgtcgtggtgacccgggcgggcgtgcccggcgacccgcgggacgtgctggtcgccgcctgcgcgccggtcttccacgagctggcgctgatgcgcgagcccgagcccggcgacctcgccgagcgctatgcggcgatcgcggtcagagggtcgaggtgaaggtgtaggagccggcccccaccacgtaggacgtgccgcccaccggcaccgcctcggcgggcgcggaggtcaccgcggtgccggggacgcgtaccgtggcggtcgtgcctgtggcgaccaccacctgcagcgtcaccgcggacccggaccggctccaggcgctgcggacccggccgaaggtcgtggtcaactcggccgacgcggaggtcagcgacccgcccggcttcggcgcgagcagcacctgggcgtaaccgggcgccgccggtgccaccccgcccacctcacggtagagccagtcgccgaccgacccgagcccgtagtggttgaacgagttcatccccgggtcctgcaggctgccgtccgggcggatcccgtcccagcgctcccagatcgtggtggcgccccgcgcgatcatgtagccccacccgggatagtccggctgctgcaggatccggtacgcgacgtcggcgtgcccgtggtcggcgagcaccggcagcaggttctccacgcccatgaagccgaccgacaggtgaccgttgcgggacgcgaccttcgccgccagccggtccgccaccgcctgcacccggtcgcccggcaccagaccgaacgcgagggccagcacgtaccccgtctcgctgcccgtgccgacagtgttgtcggcgtgcacgaaccggccggtgaacgcggccgcgatctggtcggcgagggtcccgtaggtcgccgcctgcgcggtccgcccggtcgccgccgccatccgcgacaccagccgcgccgaccagccgaagaacgccgtgctggtcagatcgttgccggtgccgtcgtccacattcagccagtcgccgtaggtgtcctggttgcggatcaggtcggcgcccgcggtcgagcgcagatagtccacccaccgggccatcgccgcgaagttgcggtccgcgggcgccagatcgccgaatctctgccagacggtgtacggcacgatcacccccgcgtcgccccaccccgccttgccggccccgccgagcacatccggtgccacgtcggtgaacgccccgtcgctgtgctgggcgtcggtcaggtcggtggcgaacttggccagcaggccgtaggtgtcgaagttgaacgtcgaggtcgccacgaacgccgcgatgtccccggtccagccgagccgttcgtcccgctgcgggcagtcggtcgggatggacagcaggttcgaccgggcaccccacaggatcgcccgctgcacctggttcagggtgctgtccgagctggtgaacatgccggtcgcggcgccgccggtccacgccgccagtccggtcaggctgtccgcgtccggtgtgccggggaagccggtgatctccacgtaccggtagccgtgcacggtgaaccgcggctcgaacgtctcggtgccggttccggccagggtgaaccggtcggtggcctgggcagcccgcaggttcgcggtgtagagggtgccgtccgcgttcagaatctcgccgtgccgcagggtgaccgtggtcccggccgggccactgacccgcaaccggtcccagccggtgaagttctgccccaggtcggcgatgaacaccccgggcttcggctgggtgacggcgaccggccgcagctcctgctgtacggtcaccccgggatcgacctgcgggaccagcgtcggccgggcgccgttctgcacggtcaccgggacccagtcgctgtcgtcgaagcccgcggtgttccacccgctcctgatcagccgcgcgtcctgcgtctcgccggcgtagaggtcgtcgcccaggatgttgcccggcgcggtccgccagctgccgtcggtctgcacggtcgccgacgtgccgtcggtgtactcgatgatcagctgggccgcgtaccagggctgcgtcccgtatcgccgactcccggcgaaaccgatgttcccggaataccagccgtgcccgatctgcgcggccagggcgttgtcgcccagccggagcgccgcggtcacgtcgtaaccccggtactgcacccgcttggtgtagtcggtccagcccggagccagccgctcggtccccacccgggcgccgttcagatacgtgtcgtgcagcccgagcgcggtggcgaacagccgcgcccgcgccaccggtctggtcaccgcaaaacctttgcggaggtacggcgcggccgccggcaccagcacctgacctccccagggaccgctgccgtaggcggccagcaccttcgcggccagccacccggagtcgtcgaagcccggctgctgccagccgcccggtgccgcggtcgcggatctccaggagccgtccgtgacgatcccgcccagcttggcgatcaccccggccgggcccaccgtcgtgttgctcgccgcgatcgcgatcgttctggtcccggccggcacggtcaccgtggccgcggtcttccacgagtcggtcacccgcgggctggccgagatttgcgtgccgtcgacccagacgtcggcggtgtcgtcgccggcgaccaccagcgtggtgctggtcgccagcgtcaccgtccggcggaagtaccgggtcgcggccggggcgctcgtcgccgggtcgccctccggataccagatccagtcggcgccgctcagatcaccggccggtggtgcgccgacgaaggccgcggtgagtgcgatgccggtgtcgaagcgggcgcccgcactccaggcgctcgggcgtccctgtgcgtcccagacgcggacgcgccagaagtaggtccggttcgcgcccagcgccggaccggagtatccgatgtcccgtgatgcggtggaggcgacgatgccgctgtcccagacgtcggccgcacccgcggtgctgcccaccgtgagctgatagcgcccctgcatctggcccccggtgccggcggcgagccgccagccgaatcgcggagtgtccaccccgaccgggtcggcctgccggttcaccgtcagatcggtgacgctcaccggcgacgcggcggccgggtcgggcaatgccaccccggcgccccacgggccgccgccataggcgccgagatccttcgcggtggtccaggcgacatccgagaacgccggatccgcccagttctccggtacgccggtggccgcccgccaggagccgtcggtgaccaggtccaccgagccggcgtgcaaccggccgagcaccccggccggcccaccggtgttgcgcgcggccagcgccaccgtgttggacccggggtgcagcgacccggccagatcgacgcggaccgcccgcttccaggagtcggcggcgcgcggcgagccggccagccggacgccgttcacccagacgtcgatcgtgtcgtcgccggtgacgaccagctgcgcggtcgcgatgtcgctcgccgcgacggtgaaggcgcggcgtaggtagcgggtggccgccggtgcgctggtggccggatcgccctccggataccagatccaatgtgccccgtcgagggtgactgccggctcggccgccgcggtgggcgccgaaaccggcatcaggagaagcgcggccgccagcaccgcgaaggaacccttcatgcgaactcccgggtatatgaaacgtttcatactgacattcatcgatcctatgacggacctcacacgccagacaagccttccgacggcggcggctccggccgatgccggctgtgacacgctggccggatgcacgacgaactgagcgcgcccgggctgcatccgctgctcgccgcccggtggagccccaccacgttcgacccggtgttcgaggtggacaccgcccaggccgatctgctcgtggaggcggcccggtgggcgccgtccgccgggaactcgcagccctgggcgttcatcgtgggccgccgcggcgacgagacgcatcggcggctcacccggcacctggccgccagcaccggccgctgggcgccgtcggccagtctgctggtcgccaacctggcgcaccggttcgtcgccgacaccgactgggagtattccgagttcgccctctacgacctcggccaggcggtcgcccacatgaccttccaggcacaggcgctcgggctgttcgtgcggcagttccgggccttcgaccggggcgggctcgcggccgagttcggggtgccggagcactgggaggtcaccaccatggcggcgatcggccgggttccgggcggggcggcggggccggccggcccggccccggtggcgtcccgggaccgccgcccggccggcgagctgcgctggacgggccgctgaaccccggctgacggtgggccggtgggctgagattggaggggtgctgaatcgcggctgacggtgggccggtgggctgcgctggacgggtccgccggctccgggtcggggctgaccggccggccggtttatccggcggcgtcccgggaatgcgggacgttcacggcgcgacggccgatcagcggccggcgtgccggacactggtggagaggcggtctgcgatgacgcgtcgcgacgtggtcgtgatcggcgggtcggcgggcgcgcacaagcctctgacccagctgctgtcccggctacccgccgatctgccggcggccgtgctggtcgtcctgcatctggcgcccggcgcccgcagcacgctggccgagatgctgggctcggcctgcgcgctgccggtgcgcaccgcggccgacggggagccgatcaggaccggtcaggtgtatgtcggtgccgccgaccggcatctggtcgtcgacggcgacgtgctgcggctcagcgacggtccccggcagaaccgggtgcgccccgcggtggacgcgctgttccgggccgtcgcccgctggtgcggaccccgggcgatcggcgtggtgctctccggcagcctggacgacggggccgccggcctggccgcgatcgtcgccggcggcggcctcgccctggtccaggatccggccgaggcccggttccccggcatgccgcgggcggcgctgcgggtggtgccgcaggcggtgacggcctcggcgctcgatctgggcgatctggtggccgggtcggccgggcagccgaccggtgcgggggaggggccgcaggaagcgttgaggtgggagacggacatgatcgccgacggttcctccgacgcccgggaccggggcgagccggtcgcgctgggctgccccgagtgccacggcgggatgtacgtcgtgcggaccggccgggcggcgcactacgtctgtcacgtcggtcactcctattcaccgcagaccctgctggccgcccgggacaacgggctggaggaggcgctgtggaccgcggtcagcgtcctgcaggagaaggtgatgatcctgcgggagctgatcgaccaggccgagaaggccggtgaggccgaggtggcgcgtggctaccgggcggaggcggaccggacgagcgccgcggccgccctgctgcaggagcaggcggccgggtcgaggaggacggcggcgcgctgaccgctgcggtgtacggtcggagaaagagttggacgcgccctctcacggatttgccggagccgatgaatcttcctgaccactcgctgcgcaccgaggttcacctgccggatgagcccggtgacgcgcgcctcgtcatcgtcggtgagctggacggcgaggagaccgtcggcctgcacgacgcggtcagccggaccctgcgccacccggccacccgggcggtgcacgtcgacgccggtgacctgatcttcctcgattcgtccggcatccggtcgctgctggccgcccgccgccgggccgccgaggccggggtcgagctgtcgatcgtcgccgtgtccccgatcgtgtaccagatcctgcagatcaccgggctgctgccgatcctcggcgtcggcgcggggacggtcgtccgtcagcccgcggcgcgaggcagcgacagggccgcccagaccactttgccaccgtcggtcggcaggtgaccccagcggtgtgacaccgcctcgaccagcatcagtccgcgtggcgcggcggggtcggtggtcgtcccgggatcgcatcgtggcggctccgccgaaccgtcccggacggcgatcatcaggtagcgacggctcagggtgaagcggaggtcggccatcgtccgggcgtggtcgaccgcattggtgaccagctcgccggcgaccaggccggccgggccggccagggcgggcagggcccaccgggtgcaggcctcggtggccaggtcccggccgcggcgggcggctccgagggtgggcagcagcacgtcgccgatggaccgggtgtgccggcgcggctcggccgccagcgcccgcgccagggaccggaagacggtcagccggctgtgcccgttggccagcgactcggcgaggccggcgtcgggcgcggcgaccagcaacggggtgtccggccagaacgcggcctgccgggccacggcggtgaacaccgacagggcggccgacccggcgacggtggtgtcggtcaggtcaacgacgatcgcgtcgggctggtcgaccaggcatttcatcagcgtggtgcgcagggtggacgcggtcggcaccgacagctcgccggccacgcggacgaccaggcgcgtgccgagccggtccacgtcgcagtgaagttcgggcaccctgtcattctccctctttttcaccgaactgcccagcgtgtggcggtcccgcccgcgtacgcacccgatgccgccggatagtagggttcggccgtgaccaaccgtgacctcatcgccgtcggcgcctcggccggcggggtggaggcgctgcgcgccctggtcgcgggcctgcccgccgacctgccggcggccgtgttggtggtgctgcatctgccgcgcagcgccccgagcgcgctgccgcagatcctgacccggtcggggccgctgccggcggcgatcgcaaccgacggcgaggagccggccccgggccggatctacgtcgccccggccgaccggcatctgctcgtcctcgacggccggatccggctcagccacggccccgccgagaacggtcaccgcccggccgtcgacccgctgttccgctcggccgcccgggccctggccgaccgggtgatcgccgtggtcctctccggcagcggcgacgacggggcggtcggtgccgccgcagtggccgccgcgggtggcgcggtggtggtgcaggctccggaggacgcgttgcacccgacgatgccgcgggccgtgctgacccgggtgccgcgggcgcgggtggcggtcgcggccgagctgggcgtgctgctcgccgagctcagccgggagaaggtgcccggtctgcccgggccggacgacccgctgctggccggcgaggtggcgatcgacgcgttcggcgagccgacgacggatctgctgcccggcgagccgtccggtttcggctgcccgagctgcggcggcgccctgttcaccttctcggattcgccggtgccgaggttccgctgccgggtcggccacgcctggtcgcccgagagcctgctcgacgagcaggcggtggccaccgagggcgcgctctggcaggcgctgcgcgcgctggaggagaaagcggagctcggccggcggatggccggggccgcgggcggccggagctaccagctccgcttcgaacagatggccgtggacgcgacggaggccggcgcgctgatccggggcctgctcgaccggttggccggcagcagcgccacgcagcaggagtgaccggtggcgcgccgcgcccggcgcccggcgttgggatagcgtgacgcgcgggcgcgatcaggagggtatgccgggcatggatgagctggatagcgagttcgaggcgctcctgacctatctgaaggagtcgcggggcttcgacttcaccggctacaagcggtccagcctgagccgccgggtgcaccggcggatgtccaccatcccggtcaccgggtacggcgactacctggattacctgcaggtccacccggacgagttcaccgcgctgttcaacaccatcctgatcaacgtgaccgcgttcttccgcgacgccgaggcctgggacttcctgcgctcggacgtgttgctcccgatgctcgccgccaagccggagggcagcccgatccggatctggagcgccggctgcgcctccgggcaggaagcctgcacgctggccatgctgctgggcgagatcctcggcccggagcagttccatgagcgggtcaagatctacgccaccgacgtggacgaggagcagctcaacgaggcgcggcacgccagctacagtgcgcgggacgtggagagtgtcccgcccgggctgctggagcgctacttcgaggtgatcggcaaccggtacgtgttccgcaaggacatgcgccgctcggtgatcttcggccgcaacgatctggtgcaggacgccccgatctcccgggtcgacctgctgacctgccgcaacacgctgatgtacttcaacgccgagacgcaggcgcggatcctcaaccggttccatttcgcgctggccgagggcggcgccctgttcctgggcaaggccgagatgctgttgagccacagcagcctgttcctcccgatcgatctgaagcggcggatcttccgcaaggtgccgacccggccgatgatgaccaccggcatcgcccgggccgatcagctcgccgccccggcgccgacgccgctggtcgggctcgaccagctgcgcaacgccgcgctgatggccgcaccggcggcgcagatcgtggtgaccgtggacgggctggtcgcgctcaccaaccaccaggcggagtcgctgttcggggtgtcgccgcgcgacgtcggccggccgtttcgcgacctggacgtctcctaccggccggtggagctgcgccgctatctggagcaggtccaggtggaacggcgcgcgctgcacgtgccggacgtcgagtggacccgcggccccggcgagacgcgctacctggacatccaggtcacccccctggtcgacggggacgccggcctgctgggcgtctcgctgatcttccacgacgtgagcgccgccaagcagctgcgggtcgacctggaacgggccaaccgggagctggaggcggcgtacgaggagctccagtcgaccaacgaggagctggagaccaccaacgaggagctccagtcgaccgtggaggagctggagaccaccaacgaggagctccagtccaccaacgaggagctggagacgatgaacgaggagctccagtcgaccaacgacgagctccagagcatcaacgagcagctgcacaacagcagcgccgacctggacggggcgaacgcgttcctggacgccatcctgtccgggctgcgcgccggcatcgcggtggtcgaccgggatctgcgggtcctggtctggaaccggcaggccgaggagctgtgggggctgcggtccggcgaggcgatcgacaagcacctgctgaacctggacatcgggctcccggtcgaccagatccggccgctgatccgggcctcgctcagcggggagaccaccgacaacgagatccggttggaggcggtcaaccggcgcggccggtcgatcaccgtgcgggtcgcctgcagtccgctgctggacgtggcgagcgtgccgaccggcagcatcatcgtgatggacgcggtcgccccctctgcctagggtcactgcgccgggcgggtagctttggcgcccgggcccgggccgggagtggtgcccgggctacgagacaggagcgccggtgaccgcgtcgacgacgagcacgcagacgacgagcccgccgaaaggcaccgatcagggcggcgggatcggctccctggaagtgctcgccctgctgctcgtgctgctggtgccggcccgcgggcggatcgccgggctgctctccggcgccgggctgcagacctgggcgacggtgttcgtctcggtgctgatgcaggcggtgccgttcctggtcttcggcgtcgtgttgtccgcggtgatcgcggtcttcgtgccgcgcggcttctgggcccgggcgctgcccagccacccggcgctggcggttccggcggccggggtggccggcgtgatcctgcccggctgcgagtgcggcagcgtgccgatcgccgggtcgctgatccgccgcggtgtgaccccggccgccgcgctcgccttcctgctcgccgctccggcgatcaatccgatcgtgctgaccgccaccgtgatcgcctttcccggccagccgatgatggcggtcgcccgcgggatcgccagcctggtcgtcgcggtggcgatgggctggttgtggctgcgggtcggcaagccggagtggatccgcctgccgcaccgccccgacctggacgacgagtcgaaggcgcgggcgttctgggcggcctgccggcacgacatcatgcacgccggcggtttcctggtgctcggcgccgccgcggccgccacgatcaacgtggtggtccccgaccggtggttgcagagcctcgcggcgtacccgctgctgtcgatcctggccctggcgaccctcgccgtgctgctctcgatctgcagcgaggccgacgcgttcgtggccgcgtcgctgacccagttctcgctgacgtcccggctggtgttcctggtggtcggcccgatggtcgacctgaagctgatctcgatgcagaccggtgtcttcggccggcgcttcgcgatgcggttcgccccggccaccttcgtcgcggcgatcctgctcggctcggtcttcgggctggtgctgctgtgagccggatggcgcaggcggtgatcatgctgttgctcggcggcgcggtggtgaaggccacggtcaccgacaccttcctgcggtatgtgaaggagggcctgcggccctacctgctgatcgccggcgtcctgctgatcgtggccgcggtgatgaccatgtggtacgagctgcgtgccgccccgcccgccggcgagcctcacgacgacgggcacgggcaggggcacggccaccacgagccgacggtgggctggctgctgctgctcccggtgctcggcctgctgctggtctcgccgccggcgctgggttccttcgcggccgggcagaccggcagtgtcgggccggccgccgcgtccgactatccgccgctggccgccggtgacccgatcgaggtgaacctgctcgactacgcctcgcgggcgatcttcgacagcgggcggagcctggccggccgcaccatcaagctgaccggtttcatcacccccggcccggacggccgaccgatgatcgcccgcatcgtgctgacctgctgcgccgccgacggccgcccgatcaaggtcggcctgaccggggtcgcgatcgacgcgccgccggacgcctgggtgcaggtggtcggcgtgtacagcagccaggtcggcaccgacccggtgaaccgggcgccggtcgcctacctggaggtcaagacctggcaggagatcgaccagccgaagcagccgtacacctagccgacggtgcgcaggtcgaggctgttgcggacgaaggaggactggtcgccggtcgaccaccagaggacgccggcccggtaggagatgttgccggcgtccgggctgaccatcaccagatgccggttgctcaggtcgtagatcagcagctgctggttgccgctcaactcggactgggcggtcacctgggccaggacctcgaagcggtcgagcaccgcgacgtcggtgatcgcggtggccacgttgccgtccagcaccttgcggcgggccgagccgtccgggtgggacaggtcgatccgggcccagccgtcctggttgatcgagaccatccggcaccaggccgggctgcaggcggtgaccgtgcgggccgccgtcgggacggcgatgctctggccggtcgtcaggttgcgcagggtggtggcgccccgggcggcgacgtggccgtcgaccgcccacggccagccggtcaggccccaggcgccgttctcccgctgcacggtgaccgggccgccggccagcggcacgctgcggaactcggtccggttcccggccgcgctcgccgcccagtgcaccctgccgtcctcgacgatcaggtcgttctgcgagtcgaagaactggatggcgccgaggtcggcggtcagcatccgggcgctcgccggatgccgccggtcggcggaccacagctgcggcttgtcctgcgggccctccacccagaccagggtgtcgccggcggcggtcagcgcggtgaacggggtgcggtgctgggccggcacccggcgcagctcggtcagagcgccgtcgccgtcccggatgaccagccgcaactgcctggtgtcggcgctctgcacggtcccggccgaggtcttcgcgtcgaggaacaggccgggcgtgtactcgctgccgtcggccagtttcgacgggacgctgccgcgctgcgcggccggccaggcggcggcgagcgccaccggctgcggcgcaccggtctgtaccggtgcgccgaacagcagcgcgccgcccgcggccaaggccaccccgagtcccagcaggttacggatgagcatggcgcgatggtagccgccggcccgggtcagtcgcccttgacgttgaccagctgacgcagcgtgtgccggatggtgaccaggtcggcggcgtcccgcatgaccgtgtcgatcggcttgtaggcctgcgggatctcgtccaggaaggcgtcggtgtcccggtattcgatgcccttcatggcggtgcgcagctgctcccgggtgaaggttctgcgggctttggagcgggagtacgcccggccggccccgtgcggggacgagttcagcgcctcggcgttgccccggccggtcaccacgtaggaggcatcgcccatcgagccggggatcaggccgggcacgcccttggccgcgttgatcgcgcccttgcgggacagccacaccgtctcgccgtagtggctctcctgctcggtgtagttgtggtggcactgcacccggtcgcgctgctcgaccggcccgccggcgaaatcggcgaagcactcgatcacccggtccatcatctcgtcccggttggccagggcgaagttctgtgcccagcgcagctcggtcaggtaggcgtcgaactcgtcggtgccctcctccaggtaggccaggtcgcggtcgggcaggtcgatgccgcgccggtccatcaggtcgcgggccacctggatgtggtgcgaggcgatcttgttaccgacgccgcgcgacccggagtgcaggaacagccagacccggccggactcgtcacggcacacctcgatgaagtggttgccgctgcccagcgagccgagctgcagctgccagttcttcgcgtagcgggccgggtcgaacgacgcctcggcggtcagccggtcgatgcggtgctgggcggaggcggtcacccgggagttgtaggagccggccgacaggggcaccgcggcctcgatggcggtgcgcagcgcggcgcggtccgggcgcaggtcctcgacccggtactgggtgcgcacggcggccatgccgcagccgatgtcgacacccaccgcggccgggatgagcgcgccgcgggtcgggatcaccgagccgacggtggcacccttgccgaggtgcgcgtcgggcatcagggcgatgtgcgggtggatgaacggcagccgggacgccttctcggcctgctgcagggtctccggctcgatcaggctggcccagttgagcaggcgttcattgacgatctgaggcacgacggcgctccctttggtgagatcgccgtgattctgccaggcagcggccgcggacagccgggaattacgccgtcgcgagcgtctcctccaggttggtgacctgcagcagcatcttcaccatcggcccgaagtcgcgcagccggaaggtcagcccgcgcgcgtgcgcggccttgcgtgccgccacaaagacgcccagcccgatcgagtcgaggaagctgacccggtgcaggtcgacctcgacgtgggcgaacccgtcggtctccacggcctggcgcagcacctggcgcagcgccgcggcgctctccgcgtcgatgtcaccctcgggcacgatgacgacccgatcgccgtgccgttcgatcgtgcagccgaagtccatgttttctcctcgcgagccggggaacactctgggtcgcgggctttccccgggtggcagagcggcaaacgcggtccgcgtcacactatccggtggtaaacgcgtgccacctgcgccgattagtactttcggttggctttatatcggctgtacggctatggttcccccatcggtcaaacagtgtgccgagattccatccagatcgcgaagggcatcggggtgcgtctctggcgcgcatgatccccggcccggacagggagaatcatgcgcttcgccgttgccgacgcagccgagaccgaccacgccgtggcgctggtcgagaccccgcgggacgacccgtcctggccggtggtccgccaggacgcgatcaccgcgtggctgccgatggcccggcgcctggcccgccgctacgccagccgcggcgccgatctcgacgacctgaaccaggtcgcgacggtcggtctgatcaaggcgatcgacggcttcgagccggaccgcggcgccgacttcaccggctacgcgatccccaccatcctcggcgagctgcgccggcacttccgggaccggatgtggaacctgcgggtgccgcgccggctgcaggaactcaacatggcgatcaaccgggcgcgcggcgagctgatccagacgctgggccgggtgccgaccgtgaccgacatcgccgggcacctcggcgtcggcgaggaggaggtgctggaggggctggagggcgcgtacgcgtaccgtcccgcctcgctgtccgccccgatcgccgcggacggtgagaccgagctcggcgacaccctcggcgcccgcgaccccggtttcgagcagaccgagctgcacctgaccctgggcccggcgatggcctgcctgaccgagcgcgagcagcggatcgtgacgctgcgcttctacggcaacctgacccagagccagatcggcgaacaggtcggcgtctcccagatgcacgtctcccggctgctggcgcaggccctggacaagctgcgcactcacctcagctaacggtcgatcgcaccgatcttgtcgatgtgctcgacatccacgcagtgctcgaccagcgggccgtcaccccggtcttccagccgctggccgacctgacctccggcctgatcatcggttacgaggcgctgagccggggcccggcggggaccccgtgggaggcgcccatggcgctgttcgcggcggcccgcgcggccggccgcgagccggaactggactggatctgccgggccgccgcctaccgcgcggcgctgcgggccgggttcggcgctgaactcaacctgttcgtcaacatggagcccaccgcgtggcgggtcgactgcccggccgacctggtcccggtcgtcgagcaggcccgggaccggctgcgggtggtcaccgagatgaccgagcgggtgatcgcggacgacccggcggccctgctcgcggcgaccggcaactgccgggagaacggctggggtgtcgcgctcgacgacgtgggcgccgacccgatgtcgttggcgctgatgccgttcgtccaccccgacgtggtcaaactggacatggggctgctgcgcgcgccggaccacccggccaccgcccgggtggtcgccgcggtcgccgcgtacgccgaggccagcggcgcgatcgtgctggccgagggagtggagaccgccgagcagatggaggtcgcccggaccatgggtgccaccctcggacagggctggcacctggggcggcccggcccgctgcccggcgtgctgccgatcggcgccgccctgccgacgctgggccgtgcccggccggagacccgcacgccgttcgaggtcgtcgcgcggcagcggcggctcacccggaccaccaaagcgcagttgatgccgatgagccggcacctggaggccctggccggcgacggaccggagccgccggtgctgctggcctgtttccaggacgcccgcaacttcaccgcggcgaccgtgcggcggttcacccggatcgcggcgcacagcccgctggtcgccgcgctcggcgcggggctgccggcgacgccggcgccgggcgtgcggggcgcgcatctgggccccggggacccgctgcgcggcgaatggagcgtgctggtgatcggtccgcaccgggccgccgcgctggtcgcccgggatctcggtgacctggccccggagccggaacggcggttcgacttcgcgctcacccacgaccgtgatctggtcgtcgcggcggcccgcacgctgctgggccggctcaccccgatcaccgggcccgcatcgacccggaataatccgacgtcgccggggcacctctccggtcatgcgagcgttgacctggcagggcaccggcaaggtgtccgttgagacggttcccgatccgacgatccacgagcccaccgacgcgatcgtccggatgacctccaccgcgatctgcggttcggacctgcatctgtacgacgtgctcggcatgtacctcgaccgcggcgacatcctcggccacgagccgatgggcatcgtcgaggcggtcggctccgaggtcacccacatcaagcccggcgaccgggtggtgatcccgttcaacatctcctgcggacactgctggatgtgttcccgcggatacttcgcgcagtgcgagaccacccaggtcaaggaccagggcaagggcgccgcgctgttcggctacaccaagctctacggtcaggtgccgggcgcgcaggccgagtatctgcgggtgccgcaggcccagttcggcccgatcaaggtgcccgccgagggcccggacgagcggttcctgttcctgtccgacgtgctcaccacctcctggcaggcggccaggtacgccgatgtgcggcccggcgacacggtgctggtcaccggcctgggcccgatcgggcagatgtgtgcgcggatcgcccggcacctgggcgcggagcgggtgatcgcggtcgacgaggtgccggagcgcctcgccatggccgcgcgcaacggcatcgaggtgctcaactcgggcagcgtcgacgacgtcccggcggccgtccacgagctgaccggcgggcgcggcgcggacggggtgatcgaggcggtcggcatggaggcgcacggctcgccgctgcagtccgcggcgatgaaggcggccgggatgctgcccgacgcactcgcccgcaaggccaccgagacggtcggcatcgaccggatggcggcgctgcggacggcgttcggatcggtgcggcgggccggcaccatctcgatcatcggggtgtacggcggcaacgccgacccgatgccgatgatggacctgttcgacaagggtgtgacgctgcggatggggcaggcgcacgtgaagcggtgggtcgacgacatcatgccgctgctcaccggcgacggcgacccgctcggcgtcggcgacctggtcacccaccggatgccgctcgaggaggcgccgcacgcgtacgacatcttcaagaacaagcaggacggctgcatcaaggtggtcctgcagccctaggagaatcgaaggtggtgccggccccacccccgtttgccgggtgccgatcggggcatcaccgggtccgtgggtgagcggttacgacgcagcgtgttgaccgggccggggatcagccggcgacgggccggcaagggcttccggtatctcggcccggacggggcggcgatcaccgacccgcagaccctggaccggatcaggagtctggtgatcccgcccgcctggcgggacgtgtggatctgcccggaaccgcgcgggcacatccaggcgaccggaaccgacgcggccgggcgcaagcagtaccgctaccacgacgcctggcggaccgcgcgcgacgagaagaagttcgagcgggtccgcgaggtggccggccggctgccgcggatccgcgaccggctctgcgccgacctgaccaccgggcgcggcctgacccgggaacgggtgctggcggccgtggtgcgcctgctcgacctgggcatgttccgggtcggcggggatcagtacgcggcccgggagcaggacccgtcgtacgggttgtccacgctgcggcccgagcacgtgcgctcgcgcggcggcgagacccggctggagttcgccggcaagtccggggtcgagcaccgccgtaccgtcgaggacggcgaggtggcggcggtcctgaccgcgctgaaacggcgccgccgggacatgccgcggctgttcggctactgggatccgtccgcccggcgctggcaggacgtcaaagccgacatgatcaacgactacctgcgcgagatcagcggcgccgagatgaccgccaaggacttccgcacctggcacggcaccgtgaccgcggctgccgagctcgccgcggccgggccgcagccgaccgaggcgaaacgccgcaaggtggtggcccgggcgatgcgcgaggtcgccgatcagctcggcaacaccccggcggtggcccgcgcgtcgtacgtcgacccgcgcctgctggagaagtacgagaacggcgaaggcccgaagcgcggcgacgagccggaggtgcgccgcctgctccggtgaccggctccggctgccggccggccgggatcacgtcccggccggccacgcaccgctcagcgccgcggctgacggcgccgctcgaagcccggcagctcgatgtgcgggtcgaggtcctccccggaggacacctgcccggccaggcgggcggtgatccgccgcgctccgggccgccgccggccgttctcgtcgggcgcgttcagctcgctgagcagcagctccgccttgtcgcccatcgaccgggcgatctcgtcgaacgggatgtacagcgcccggttggcggccgaacccaggtattcgaacggctcggacccggccatcgggatgaaccggcagcccagcatgtccaggttgcggaacgcggcctggtcgagcatgcagaccacgtgccgcacctgccagcggtgcccggcgttgatgaacgcgcggtagagcatcacgctgacggtcagcccgctgcggtccgagcggtaccggggcagcaccgcgagcgtcgcgtagtcccagatcttgccgccgtcgtgcatgccgtgcacgtcgacgatctcggacagcggcttgccgatcaggtcgggcgcgtcatccagcgtcttcccgccaccctcgatcgcccgcgcggcgccggccggcatgccggtctcccggtcgagcaccaggaagaagtagctctgctcctcgtatgcggtgtactcggcgaccatcgcggtctcgccgagctggaacgactcctcgaagaccacccgctccacggtccgcgccacgtcggccagcgggtcatcgtggctgagcgcgagggcgacgaagcggttggcggaggggtgctggcgcagcgccacagcgcagagagcgtgcatggtggcgtcgtcgagcgcgtaggacatcaggcggactccttcgccctggcgccggaggagagcggcgcggcaaggcattccgggggatcggacttgtccagaattaagcgtagatgtcatgacgtcaatcgggcgaacatcacaccgcgtaaatcctcaaccacccggaggcagggtgaagcagcgaaggtcgggcgacctcgaccccggtgccgtcggcgacgggatctcgtgcgtcgccacggacggcgcccgcgccgctcgcaccgcctcctgcacgcccgggtcggccggccggagggggctgccgaagttcgccaccaccccgcccggcgaccaggcgggtggctttgccggtgcccgcgtcgatctccagtgccgtccggatcggaccatccgcacaggcggcgatcacgtcggacagctcgcccggatagccggggcggtagcgttcgtaggcggccgcggccgggccgaagctgagcgccctcatacccgggtgggcagcggcccgccgtggtaggcgaccgcgtcgctgaacgcggcgatcaggtcgaggtcggtcccgtggtggtcggcgtagtaccggtgcaggttgagcaccagccgttcggcgtccgcccagccggcgaattctcccaggtcgacggcgcgggccgcgtccagcggcggccggccgtcggcgatgccggccgcgccggcgtccaggacgaggtggtagtagcgacggtgttcgtcgaggacccgggcgatgtcggcaccctccaggatcggcccgtgcccggggacgatcacttccggtgcgaggccggccagccagtcgacggcggccagcgcgccggtcaccgagcccatgaagacgagcggggtcagcccggcgaagaccaggtcgccggtgaacagcacgcgggcgtcgggcacccaggcgatcaggtcgccggtggtgtgcgcgggcccgcccgggtgccgcagctcgatccgccggtcgccgaggtgcacggtcatcgcgccggtgacggtcaggtcgggcagccgccgggtgacgtcaccccagtccggcaccggcgaccagaacggcgggcagccgtcgatgatcggatcgacccgcagcccttcgcgcatgttctcctgcccgatcagcacggttgcggcgggcagcaggcagttgccgtacgtgtgatcgccgtgctggtgggtgttgaccgcgagtttcggcgcctgcccggtcgccgcccgcagtgtctccaggaaccgccgcgcccgcgtctcggtcgcgcacgtgtcgaccacgagctgcccgtccgcggtgctgaccgcgcccgcgttgttcagccaccacgacccgtcggcctgcagccaggcgtgaatccccggccgtacctcgatcagctcgcccatgccgtgagattaccggccgggaagatttgcggcgggaaaggacgccggcggcaaatcatatcggttgtacgaggatccgcggcgctgaaaggattctgtcatgcgccgcatttctcagcgagtttccgccattgccgaatccgccaccctggccgtcgacgccagggcgaaggcgttgcgggccgccggtcgcccggtcatcgggttcggtgccggcgagcccgatttccccacctcggagcacatcgtcgaggccgccgcccgggcgtgccggcgcccggagtcgcaccgctacagtccgaccgccgggcagcccgcgctgcgcgaggcgatcgcgcaagcttccccgttgccgctgaccgccgaccgggtgctcgtcaccaacggcggcaagcaggctgtctaccaggcgttcgccacgattctcgacccgggtgacgaggtgctggtgccggcaccctactggaccacctacccggaggcgatccggctggccggcggcgtgccggtcgatgtgccggccgacgagtccaccggttacctggtcaccgtcgataagttggcggcggcccgcaccccgcgcacccgggtgttgctggtctgctccccgtccaatccgaccggcgccgtccattcccggcaacaactggcggagatcgggcagtgggccgtacagaacaatctcttcgtcgtcaccgacgagatctatcagcacctggtctacggtgacgcgcaattccattcgctgccggcgctggtgcccgcgctcgccgaccggacgctggtgctcagcggcgtgtcgaagacgttcgcgatgaccggctggcgggtcggctggatgaccggcccgcgtgacctgatcgacgccgccgccaatctgcagtcgcacctcacgtcgcatgtgggcaacgtcgcgcaggccgccgcgctggccgcgctcaccggcggcctggacgcggccgagcggatgcgctcggcgttcgaccggcgccggcgcaccatcgtcgggatgctcaacgacatccccggcgtggtctgccccgagccgcagggcgcgttctacgtcttcccgtcggtccgcggcctgctcgggcgggagctgcgcggccgccgcccgcagacctccgccgagctggccacgctcatcctggaggaggcggaggtggcggtcgtgccgggggaggcgttcggcatgcccggctacttccggttctcgtacgcgctgggcgacgacgacctggtcgagggcgtcacccggatcgccaagctcctctgacttcgttcgggtgcaccccggccgaaaacccggtgcgtgccgggccggctggtcagcgttcacctgtgaagatcctgacggcgatgctcggcgccgccctggccctgtccccggcggcgcccgcgcacgatgagaagatcgcctacacccggtggacggcgctgccggcctggccgcgaccggccgggcgcaccacctacgccggccgggcctgggagtcggcgagctggaccgggccggtgcaccggatcggtttcggcgcctcccagctggtcgcctcgtgggacgcgcggactccggccggtacctggttgcaggtcgacatgcgggggacctacaccaacgggcagaagacgccctggtacgtgatgggccgctgggcgtcgggtgaggaggcgatcaggcgtacctcggtgcgcgggcagcacgatccgtactcgtcgatcgacaccgacaccttcacgatcaccgacccggcccgcggggtgctgctcgccgactaccagctgcggctcaccgctttcaccgccccgggctccgcggtgctgccggaggtccgggaggtgggggcgatggtctccgacgtaccgccgcgattcgaggtgcggcgcagcgacggccacctcgcgtgggggcgggaactggcggtgccgcgccgctcacagaagatccatgccgggcagtatccgcagtacaacgggggcggggaggcgtggtgctcgcccacctcgacggcgatggtggtggaatactggcatcgtgggccgagccgggcggacctggcctgggtcgatccgtcctacgccgatccgcaggtcgacaacgcggcccggcacacctacgacgtcgcctacgacggcaccggcaactggccgttcaacaccgcctacgccgccggtttcgacctggaggcgatcgtcacccggctgcactccctcgacgacgccgagcatttcatcgcggccgggatcccggtgatcacctcccagtcgttcctgccggcggagctggacggggcgggttacggcaccgccgggcacctcatggtgatcatcggcttcaccaccaccggcgacgtgatcgtcaacgacccggcgtccgcttcggacgaacgggtgcgccatgtctaccggcgggagcagttcgagcggatctggcagcggacccggcggcaccgcgcggacgggaccgtgaccaacggcagcggcggcatcgcctacctgatcaaaccgtggacgacgccgtggccgcgggtgcctggcgccacgaactggtgacccgttcgccggagaccactacgcggctgtatcgggagtcgaccggcgagccggtggcgttcaccgaggactcggagcgggtgttccccttgacggcgatcaccggtgcggccttggccggctccgctgacgaccgctgcccacgccggaagtcggcgtgggcagcggtcgtcagcgacagcggtcagcgtttccgcttgcggtcccggtcggcggcgatgtcctcggcgtaggtcgcgccgccgtccgattcccgggtcagcgggcgtgccccgccctccggcggaccggccagcgactgctcgccggccgcgaggtgcgggtatttcaggtcgaaggcgggccgttcggagcggatccggggcatccggtcgaagttgcgcagcggcggcgggctgctggtggcccattcgagggagttgccgtggccccacgggtcgtcctcggtgacgaccttgccgaccttgtacgagcgccacacgttgtagaggaacggcagggtggcggcgcccaggatgaacgagccgatcgaggagatcgtgttcaggccggtgaagccgtcggtgggcagaaagtcggcgtagcggcgcggcatgccgcgggtgccgagccagtgctggaccaggaacgtggtgtggaaaccgatcatggtgagccagaagtgcaccttgccgaggcgctcgtcgagcatccggccgaacatcttcgggaaccagaagtagatgccggagaacacggcgaacacgatcgtgccgaacagcacgtagtggaagtgcgccaccacgaagtacgagtcggagacgtggaagtccatcggcggggaggccaggatgatcccggacaggccgccgaacaggaaggtgaccaggaagccgaccgcgaacagcatcggcgtctcgaaactgatctggccacgccacatggtgccgatccaggtgaagaacttcatcccggtcggcacgccgatcatgaaggtgaggaagctgaagaacggcagcagcacctggccggtggcgtacatgtggtgtgcccagacgctcatcgacagggcggcgatcgcgatggtggcggcgaccaggcccttgtagccgaacagcggcttgcggctgaacaccgggatgacctcggtgatgatgccgaagaacggcagggcgatgatgtacacctcggggtggccgaagaaccagaacaggtgctgccagagcatcgggccgccggtggccacgtcgaagacgtgcgcgccgaggacgcggtcggcggccagggcgaacagcgcggccgccaggaacgggaacaccatgatcgccagcagtgcggtgaccagcatgttccaggtcatgatcggcatccggaacatggtcatgccgggtgcccgcagggtcaggatcgtggtgatcaggttgaccgagccgaggatcgtgcccagaccggagatggccaggccgaccacccagcagttcccgccgatcccgggggagtgcagcgagtcgctcagcggggtgtaggcgaaccacccgaagtcggccgccccgccgggggtgatgaagccgctgatcgcgatcagcgtgccgaacaggtacagccagtacgcgaacgcgttgagccgggggaacgccacgtccggggcgccgatttggatcggcaccacgaaattgccgaacgcgaacacgatcggggtggcgaagaacagcagcatcgccgtgccgtgcatggtgaacagctggttgtactgctccggcgagagaatctgcatgccgggccgggccagttcggcgcgcatcagcagcgccatgatcccaccgatcacgtagaagatgatcgacgtgatcatgtacatgatcccgatctgcttcgcgtcggtggtccgcacgatgcgggccagggcggatcctcgcacctgccggcggatcggatggggccgtgtgggggtgggcctcgcggcgacggtggtcatccagcctcctcggctgcgattgaggatccagtgctcaccctctgttataggcttatcaaacgatatttcgtgccggatcgggtctatcgggtggccggtgtgctggaagagaaggatcgtcgcgcgctcgcggagatcgagaatgagttgacggtcgccgatccggggttcgcccgccggatgcggcgcggagacggcgagctgcccgccgtggcggcgtcgtgcgtgctggcattcctggccatgccgttcaccgcgctgctgttcggcccggccgcggtcctggttgtcgtcaacatcgcgatcgcggtgatcatgctggtcgtcgcgtcccggtgagcccggccggccggccggcgccatggcgatcatgctggtcgtcgtgtcgtgtcgatcctggccggccggatctcctcggcctgctcgtcgccggctctccggcggaaagccggagtgccgacgggcgtcagtcgatcagccaggtgatcagcgacatgccggccggggacacggcggccaccagcaccagcagcatggccaccgcgctcccggccagcgtcgcggtcagcccgcggcgcccggcggtgtgcccctgcaggaacagcgccaccgagacggccaggcccagcccggccagcagtggcgccaccggcaggaagaacgtcacgaaatagccgcccgtccaaccggtcagcacgtcggcgttcgcggtgtaccggtcgtcgggggagggcacgtaccagtgcccggcgaagtccgcggcccgcgccagcgccgagcaggcacacagggcggtcagcgccgccaacgcatactgcgcgccggacagcacccacaccccggtccgccggcgggacagagccggcaccccgttcaccgcagcagcagtcatcggcgcatagtagacgatcgttgccacctagggcgccgcctcggtcgcgaccggggtgaccggggtcgtcagccggcggtagccgatctgccacaaagccagcagcaacagccccgccaccagcgaccaggccggcaggtgcgccccgagaacgccgagcactagctagctaggatcgccacgatcgccgcggtggtcaggtagtgcaccggcatggtcagccgcagggcgcgggaccaggcgccggcgaccggggcggcggccgagccgtactgcagggtgagccaccacagcgcgacgaggagaccgaaaccgaccaacaccaggatccacatctcgtacgaccattgctcggtcccggccgcctcattgaccagctgcgcgaccgcctcgccgagcacgatgatcacgaacaggccgagccgttcgcccaggtgcggccggtcggcggcggccgccgacggcaccgggtcggcctcgtgccagggcgcgatccggcggaccagccgggtcgtccagcggcgctggtcccgctcgtagtcgctgatctgttcggccagcacccggtcgggggagccggaggcgcgcagggtgaagcccaggtcgacgacgatgccgagcacccacagccagtaccgggccggttcctcgaagccgagcgaggcgacccacgggaccaggccgatcgcctggtgcacgccgggccactcggtcatcacctcgttcgaccgcttccatgaggcgacggcgagcatccggcaggcgacgtaggcgatgatgaacggctgcggccggtcgtgctcggccagctgcggcaccgacgcggccatcaccgcgatcccgaacatcgcggacagcatggtgagcagatgggtgccggtggccgccacgttggcgtacagcgtgaagccggtccacacgctccacatcgcgtagtacagcaccgcgaagatcagcagctgccggccgtccggcccggtgtgcagcaggtgggccagctgggcgacagcggccacgatgaccaggtcgaagaagagctccagccaggtggcgtgccgttcctcagtggtggcgtgcgacatgtgcggaaatttatcgcagtcaccgtacgccccgcgtgtcgcgggcgagcgtcgtgaattcccgggcgtggtggatcagcgggtcgtcgtccggtccgtggaagacctccaggacggtggcgaccaccagggtggagccgccgaccgggagccggtgcatcggcgcgcagcgcagcgcggcgaccgcgtcgggcaggatcggctcgccggtcggcagggtgcgccagccctgcgccggggtgaaccggtcgccggccgtatgggcgaactcccgggccaggccggcgtgccgcgcgccgagcaggtgcaccaccaggctgggggagtcgagcagggcgcgcgccgaccgggtgcccaggaccgagaacgacagggccggcgggtcgaccgcgaccgaggcgacgctcgacgcggtcagtccggcggggccgtccgggccggccgcggtgatcaccgcgaccccggtcgggtagcggcggaaggcgccccgcatgcggtcggcgacgtccaggcggggctcggtgtccagatccacccggggaccgtagaacctcaacccgaattcaggtcaacctcagatgcgcgggatcacaaccttggcgaccttcttggcgtcgcccaggttctgctcgtcgctgccgccgcgggagtagacgtcgacctgcacggtgccgtacaggacgtacaggtggccgttggcggtgaaggcggcctggccgacgccgtcgacgtcgtgcgcctcggcgacggtgaccttgaagtcgtcggcggtggtgcggctcaggaagagggcgagctggccgctgtcctgctgccattggcagaagcgggagacgtcaccgggtgcggcgccgtcccggtcgacctgggtgatccggcgaccggtgaggctggtcacctcggccctggacaacagcgtacaaggatccggaatgtcgccgttgtccttgatggaggtcggcgagacggaggccgcggagaccgcgggggtcggcgcgacggtcggcgccggcgcggcgtccgcgttgttgatcacgccgcagcccgcgctcgccagcaggacgaccgggacgagagcggtgcggcggtgcttcaacagggtctccttaacgcggtgtgcgaacagcgcatcacaggaggccgccaaaagcccaggtcagtcacccggtaggtggtaggagggccgcggtggacacgcaccgcggcccccgtcgttcatccgcgcggaccgggcccgcccgcgtggtgcggccagcccggcaggtccgggccgccgggatgcccggtcgcgccgggatacgccggccggcccgcggtcgacggaccgctgccgccccggcgcaccaccagctgccacagcccacggtagacgccgtcgccccggtcacaggtgtagttcagccagcgtccgaccagcttgccggcctggccggtccactggcagtcgcccagctggccgaagtatccggcgacatcgacgttgaatcccggcggcgggttccccgcggcctgggccggcgcggcacccacggcgaatccggagacaacgccggcggccgccatgagcagccctttcgccttgttcatccctttcagcctctctgttcgggagtcgcatgcgccccgagtagagcagagccgcgccgggacacgggcgttgtcctagctttgcgcccgggtccgggaccgggcgcggataatggcctggggtcagtgcgggctgacccgcacctcgggcgccgccaggccctcgaaccaggccgcctcgcgcagcgtggcgagcagccgctgccgacccgcctcgtcctgccggtcgaggaacaggatgccgtccaggtggtcggtctcgtgctgcatgcagcgggccaggatgccgtcgccgaccacctgcaccgggtcgccctgcttggtgaacccgcgggcgctgacgttcatccggcgccgggtgtccaggtagatgccgggaatcgacaggcagccctccggcccgtcctgctcctcgtcgtcggggaactccagcaccgggttgaccagatggtcgagccgcaggtcgttgcccggcaggtcgggattgatcgcgaagacccgcaggctcacgccgatctgcggggcggcgagcccggccccgtgggaccgcaggagcgtctcggtcaggtcgcgcacgagccggtccagctcggcgtcgaagtcggtcaccggctcggcgacccgccgcagcacggggtcacccactttgcgaatgtcaaccacggtcacaggggaaccgtactccccgggcggcccgcgacactgacatccgtcaccgtcgaaccgtgacgatcgggggcggtacccggccgggaacgtccatagtgtcatcggcgccctgtcggatcaccaagttcagcctggtcggcggcgtgcacgtggaacgggtctgatcgccgggtgtgcccggcgtccggtgggggtatcgcgtcggacgtggacgatgagcgcaagggcccggagaagggcgacagcacctggaccgtgatcgtggcggtcgccgccaacctggcgatcgcgatcgcgaagatcgtggcggcgctgctgaccggttcggcctccctctgggcggaggccctgcactcggtcgccgacaccggcaacgaggtgctgctgctgatcgggctgcgcaagtcgcagaaggggccggacgcccggcacccgttcggctacggccaggaacgctacttctggacgttcctggccgcgctcggcatcttcctgatcggcggcgtgctgtcgatcggcgagggcgtgcgcagcctgctggccccggagccggtcgactcgttctgggtgggcgtcggcgtgctggtcgtcgccgccggtttcgagagctactcctggtacaccgcgcacaagcagctgcgccgggaggccgacgagcgggaccggtcgatgcgccaccacctgcggcacgcctccgacccgagcgccaccacggtcttcctggaggacaccgccgccctgatcggcctggccgtggcgctgaccgcgctggtcctgcacgagacgaccggctgggccggctgggacgcggtcggcagcatcaccatcggcctgctgctgatcgtggtcgcgttcctgctggcccgccggtcgaaggcactgctgctggacgagtccgccccggccgacgtgctggacccgatccgggagcgggtggaccggcaggactgggtggcccgggtcggtgacctgcacgcggtctgggtcggcccgtcccagctgctggtcaacgtccgggtgaccccgaccgactccgacgagctggtcgaacgggtcacccggttgcgccgggacctgcaggacgacgacgtgatcgcactggtcaccgtgaccctcgaagcctgacgctcaggacgcgtaggtctcgaactcggcgatccgcggcgtaccggaagccgtgatgatcttgaaagtgatcctggtgagcgacacggcggggaaggtgatcacaccggatccgctgcccgacgcgaggaccgcgccggtcgcgccgttgaggatccggtacgtcgtgaccgcgctgccgatctcccggacgttcacccgggaaaccgtggtcgccgagccccacttgatcgagatgtccccggtcgacccgctcggcgaccagtaggtgcccgcatcgccgtccttgacgttgccgtaactggtgccgcccgccttgctggacccgtccgccccggcgcccaggctcaggttcgtcccgctcggcggcgtggtggcggacggcgtcgggctgccggtcgcgctcggggaggtggtcgagcatctgccgtcggacaccttcagcccggtgttcgcgccggcggtctgccgcacgatcgccggcacgcaggaggcggcgtccagcgtgtacgcgtacgggatgctcacgctggtgttggagaccgggtccgggccggccgggttggtctcgccgtccggtgccgtccacgtcacattgtcgaagatgttcccgctgacctgccagtatccggccgcgtcggtgtagaaggtgcccagcacgttctgcgagtcctggaagtagttgttgtccacccgcgccttcgccccggcccgcgagttgatcccggacttgttcaggcgcacgtaatagttgttgtagatgtgcgcgatgccgccccgcagcagcggcgtacgggagtcgatattttcatacagattatggtggtacgtgatgtagccgttgccgaggtcgctctcgctggagcccaccagcccgccgcggcccgagttccgcagggtgctgtaggacagcgtcacgtactgcgtgttgtccttcatgtcgatcaggctgtcgtacccctgggcctcaccgccggaggccagcaggttcacgtggtccacccagacgttgcggacggtgctctccatcccgatcgcgtccccgccgttcgaggtcggcgaaccggacttcttcacgttctggatctgcacgttctggatgatgatgttgctggagtcccggatgtggatgcccagctggtcgaagaccgccccggcgccgaccccgacgatggtcacgttgctgacctgcttcagttcgatcttgtcggccgcggtgttgcagccggcgccggagaccttggtcgtgttgccgtggttgatggtgccctcgacctggatgacgatcggggtgctgctggtggcccggctgcacagcgcctgatggatctgcgtgccggtggtggcatgcacgaccgccccgccggcgccgccggtggtccccccgttctggccggcgtaaccggtggcgccggccgtcgcggcgttcgcctgggggagtggcagggcgacggcgatgaccccggcggtgacggcggtcccggccgccgcgatgatgcggtttctcttcacgatgcggcgctccttggggatgggatgcaggaaagcgctttcctatgctggtgtgaccgagcatagaagcccagcgattaacaaacaagaaacacgcccgtttgcattttgttgcatttgacagcgcgccgaaccgctcttccgggccgttgccgccgtcccgctgggctccgcgcacacccgcgcgctgggctccgtgcacacccgcgcgctgagcgctgcggacatcacggcgtgcgcttggctctgcggacaccggcgcgcttggcctcgccgacatcggcgcgcctggtcccgtggacaccacggcgcgcctcgcctcgcctcgcgcagcatggcgcgcctcgcctcgcgcagcatggcgcgcctcgcctcgcgcagcatggcgcgcctcgcctcgcgcagcatgccgcgcctcgcctcgcgcgcagcacggcgcgcctcgcctcgcctcgcacgcaccgcctcgcgcgccaagccccgcgcagaggatggtgtgccgttacgccatatcggaccgtcatggcagccgcccggcgagcggtgtgatggtggtggtcgcgtcccaggtggaggcggtgggatccgcggttggtggcgcggatggtggtgggtgatggttttcctggcggcctttgcggtggcgcaccgtggcgggagtgagggcgcgctgcgggggaccggtggcgcttgctgcgcaggtggcggcttcccggtgaggtggttttggtcgggtggtgcggggaatgcggcgcgcatgacgacgaccaaggaagatcggcaggcggaggagcggcagcagcagccgcccgggcacaccgggctgatgaaccgcaagccggatcacggggaggattcctaccgcgggtcgggtcggctcatcgggaagaaggcggtgatcaccgggggtgacagcggtatcgggcgggcggtggcgatcgcgttcgcccgggagggcgccgatgtgctgatctcctacctgccgcaggagcaggacgacgcgcgggagaccgcggcgcaggtggaggcggcgggccgccgggtggcgctggcgcccggcgacctcaccgacccggcgcagggcgcgaagatcgtcgagcaggcggtgcgcgacctcggcgggatcgacgtgctggtcaacaacgcggcgttccagatgacccacgagagcgtcgaggaggtcaccgacgaggagtggcagcacaccttcgacaccaatatcaccgcgatgttccggctggtcaaggcggcgcttccgcatctcggcaagggcgcgtcgatcatcaacaccagctcggtgaactacgacatgccgaaaccgacactgctgccgtacgcgacgacgaagggcgcgatagccaacttcaccgcggggctggcgcagatgctcggcagccgcgggatccgggtgaacgcggtcgcccccggaccgatctggacgccgctgatcccgtcgacgatgccgcccgagcaggtcgcggaattcggcaagaatacgccgctgggccgggccggggagccggccgaggtggcgccggtctatgtgctgctcgcctcggacgaggccagcttcatctccggcgcgatcattccggtgaccggcggaaaacctatcctgtgatcacccgggaatgcgaaagggccgccggttcggcggccctttcgtgcccggcaatcagcgcttggcgcgtttcgcggcggtcttctcgtcgcggaccccgctggtcaccagcgtcccgtccgccgattccagatgcgcccggacgaaccagtggaactgctccagctgcccggcctgcgcgatcagcagatcctgggtgaccgggtccggctcgtcggtcttctcgatcgcctcccggtgtgcctccagcaccccgctgtagacgatgtcgagcgcggccaggtgcgagttcgtgtcggcgcgcccgatcgagtagtcgtcccaggtgcgctgcgcgaccagcgcccccggcgtgccgaccggcgagccgcccagcgtggcgatccgctcggccacgtcgtccaccatcacccggaccgcgtcgacctgcgggtcgagcatctggtgcacggcgatgaagtgcgggccgaccacgttccagtgcacgtgcttgagggtcagcgccaggtcgttgagcgcgttcaaccggtcctgcagcaccgcgatgatctcgccggccacgtcgggcttgaggcccggcacggtgtagctcgggctcgtgttgctgaccgttcgcttgcgtgggggcatgcgcgtctcactccttcgtgcggttacgccgtggcatttccccggtgggatcaccggcaaacgaaaggggcgggaaggtgggatcgagcccacattcccgccccttccgccgatcagacgtgctgcgtctcggtggtcgacggatgcaattccgccgtcgtcttccggacgaagcggccggtgctggtactgcggtgcacctcacgctcgccgctgttcttgccgacccgctcggtggtcgtggtgcgcggttcgcgctccgcggtggactgcttgacgaagcgcccactgcgcgcgctgcggttcacatcgtgttccttgccggccatgtcgcgtcatcctccttcgtcgcttgtcatttctcttgcccgacggaggcgaatggaaacgtgttcatgtgccgattccgagtcgcccggcgagcgacgcgacgtccagggcggccggcggcggccccggcgtcaccagggtgagccgcagcaggtggcgcaccggcgcggcggtcaccgtctcctccgggcgcgcgtggatgcgggccaggcaccccgggagcaacaccgggagacggtacgtccgggccagccgcaccgcggtctccgccgtcgccgcggcccgcggtgccgcgcccagcgtggtcagccgcgcccgcagcacctcggcggacatgtcgaacgtgtacaccaccacctgccggtcccggtacggccgccgtccccgccccggccccgccaccccggccgggaacagcatcgcgtgcccgtcgcgtccgatcggggtcgccaccacgcccggcggcagcaccacctgctcggcgatcgcgaccaccgccgcgtccagcgacccctcggccacccaggcgatcagccggtccccgtggtcggccacctgggtgaccggcgggtccagcgccgggaacagcagcggcgccaggctggagaacgtgccgaccgacagtggtcgctcgcgcgccgccgcccgggtctgctccaccaacgtcgccaggtgctgcaggatgtgcgccgcccgctcggccatctctcgccccgccccggtcgggcgcgccccggtcggatcccggtcgaagagccgctcaccgacccgccgctccagcgcggccagccgctgactcgccgacggctgactgaccagcagctcgcgcgccgccgcaccgaccgacccgagccgcgcgatcgcggtcaccaggcgtagatcgtccacctccggcaatgaacccataggcacaccctatggctgccgggcactccctgccggctacccacggtcaccggagggcggcagcctcgagggcatgagggactaccgcgacctggccgcgctgctgctcaccaccttcgtcagctggttcgggcagcgcctgaccgcggtcgcgttgccactggtcgcgctggccgccacgggatccgcgggcagcaccggcctggtcgccggcgcggccggcctgccgctggtcaccgccggctggtgggccggcccgctgcgccgccgggtcaccaccgggcgatcgctgagcgtcaccctcgccgcgcaggcggccggcctgctgatcgtcccggtggccgcgctcctggggcgggtcaccgtcgtaccgctgatcgccggaggcctcttcgccggagtggccgccgccgtggccggccccgcccgccaggccctgaccgcggacctcgccgaccggatcggccccggcaccgcggcccgggccctggcctggcaggacctggcgcaccgggccagcatggtgatcgccccgccgctggccgccgcggcggtcgccgccggacacaccaacgccttgctgtggtccgaaagcgccggcatcgccgtcgcttccgcgctgctgtcggccgtacgcggtgacccggcccccgcccgcgccgcgacccctgcccgagtccgcgtccccgcggccgcctctgttcccgcccccgtgcccgcaccggaaccggcggcgtccctgcgcgcggtctggcgccgtcatccggacctgcgccgcgtcctggtgatgagcgcggccgccggcctggtctggttcgccttcaccctcggcctgaccgtcctgggtgccggctcgggccgccccggcgtgctgatcgccgccggcatgaccggttacggggccggatcgatcgccggtgccctgctcgccccgctgctcaccacccggctcccggccctgcccaccgccgccgccggctggatcatcctgggtctggccttcatcgcgatcgccgcggccgccggctccgtcccactcatcgccggctgcgcggcgatcggcggcgccgtcgtccccttcggcatcgccgccgccaacaccctgatcagcacccgcaccgcgggtgccgaacgccgggccgcgttcgccgcggagagcatcctgcacgacggctcggccacgctcggcatgctgctgggcggcccgctgatcgccctggccggcccccgccccaccctgctggccgccggcctgctgcagatcgccgtcgcgctaccggtcctgctcaccgcgcgccgcgaggtgaccggccgcggctgcccgccgccggttaccggtcccgcgtaggggtcgcccgggtcgtgggataccggtttcaccccgtggtccggcggccgaaaatgaaggctgtggatgtcatcgtgcagcgagtccggaccacctggagcaagcagtcccgcggcaacccgggcgcggcgctgcgcagcgccgtccccgaggcgttcccgctgccggcggccggcgcgccgctcttccatgacatcaccgtcgccgaggacgaggatttcgtcccccgcgaggcgatcctcccgcagcccccggccgccgcgttcggtctgcgcctggtcggcaacgccctgcgcgtccagctgccgaacggccacggcgctccggcacgcgccccgcgcccggtgctgaccctgcgccgcggcgactggctgcgctggcacctgaacaaccggcacgccgagcagaccggctggtattacagccagaccacggtcagcatcgccttcggccccaccgccccggacaccttcctcggcgccccgccgcacaccatcgacgagcgcgcccgcctccgctgacgatcggcccgccgcacgccacgcggtggggcgccgcgtccggctcctcgagggtgaggccgtgccgggcgcggacaggctcagcccttcagctgctggatcttgtccttgaacagggtcgtcgcgatcgacgacttgtgcggctggcccttgagccacgcggtggcgaacttcttggcctggtcgtaggtgactttcccgggcagcggcggctcgtccgggttgaccgccacgtcgagcagcgccgggccgggatacgccagggcctcccgcagcgcgcccggaaggtcgccgggcttggtgacgcgcacgccgtgaccgccgctgcccgacgcccacccggcgaagtccggcagcggttcgccgaagcggacgccgtgctcggggtagccgagcaccatctgctcccagaggatctggcccagcgcgttgttgttgttgatcaccactttgaccggcaaccggtaccggaccgcggtgtggaactcggccatcagcatcgcgaacccgccgtcaccgacgtacgcgatcacctgccggccggggaacgcgtgctggatcccgatcgcgtacggcagccccggcgccatcgtcgcgagcgttccggacaggtagaactcccggttgccgcggatctgccagtgccgggccgcccacgtggcgacggtgcccgagtcgcaggtcagcaccgcgtcgtcggccgcgtgccggtccagcaggtgggccaggtactgcggggcgatcgggtcgcggtcgggcgcctccagggccgccatcgcgtgctgccagtccgcgtacctctcccggtagccgctcagatgtgtgccggtcttgcgggtcagcagcggcagcagcgcccgcagggtggccccgacgtcgccgaccagcggtacctcggtggggatccgggtgccggcccgggccggctcgatgtcgacctggaccaccctcgccctgcccggctcgggcaggaacttggtgtacgggaagttggtgccgagcatcagcagggtgtcggcctcctccatcagctcctcggccggtctggtgccgagcaggccgaggccgccgatcgtgtacggcgagtcgtccggaaccaccatcttgcccatcagcgacttgacgatcggcgcgtccagcgcggcggcggcctcctcgaccagcgcgccggcaccccgggcgccgatcccggccaggatcgccaccttctcgccggcgttcaggatctcggcggctcggcgcaggtcctcgtcggccggccggaccgcgggggcgaggtagatcggcgacgtcgacggcggccggaccggtgccaccgactggtacgggtcctggtgcgccggcgcgatctgcacgtcgttcggcacggtcaggtgggcgaccccgcggcgcgcgtacgcggtccggatcgccacgtcgacgaccgtcggcagctgcgccgggttcatcaccacctggttgtactcggccacgtcctcgtacagccggtccagcgccacctcctgctggtagccggtgcccagcacgctgctctcctgcagcccggtgatggccagcaccggcacgtggtccagcttcgcgtcgtacagcccgttcgccaggtggatgccgcccggtccggaggtggccaggcacacgccgatccgcccggtcgccttggcgtgcgcgaccgccatgaacgcggccgcctcctcgtggtgcaccagtacgaaccggaccttgtcggcgtgccggcgcaggccctccatgatcccgttgatgccgtcgcccgggatgccgtacacggtgtcgacaccccaggcggccagtcgctcgatcagaacctcggaagttatctcagccactcagtggtgctacccggatggggccgcttcattccgcggcggggaaagccgccggcgcggtggacgacgcctgcgggtccggggtcagcacgatcggcgcctcgatcaggtgcgggcgcagccggtcgtcgggagccagccacgactcgtgcggagcgccgtccggcaccgcgcgccagcgccgggacaccttgcgcaccccgatcggatagatggtcagggtgccgtcggcggccacgtggaaccgcaggaacgacttcgagtccacgatcccctgtgccgagaacagctcgttcacattcacgtcgaagcgggcggcgatcagcagatagaccgcgaccagttcggtgccggccagcccggacaccacgccgtagatgacgatctcggcgatcagtgaccacggccacggccagtcgtgcagcggcagctcccaccacgcccaggtgcccagcgcggccagcgccaggtgcgcggcgccgtgcagcaggcccagcacccggcgccggaacccgccgcggaccgacctgctcaggtgcgcgaacgcgtacgacccggccaccaccagggccatcagcacgaccagcggggccagcgcgaacttctgcaacgggctgccgaaaccgctcttgaggaccccgctcgcggcgagcagcatcatggtgtgcacggcgccgatcatgccgatgaagctcgggttgtccttgggcagacgaccgaaaatgcttgccgcgtacgcctgtgaccgcaacttccccgggaaacgcgagcggaggctgtacttcacgcgcggcgacggcgagggcaggtcggccggcggcacctcgatcgtctccggcagctggtgggtggggtacaggtaggcgccgccacccccgcaggtgatcagctcccgctccgcgccggagtaccgcgcgtagtggtgccagtcgccggagaccatcagccggatcttcgccccggtcggctcgatcaccgcccgcacgaagtagtccagcgacgcgtacacctcgggcacgtcgtcgccctgcacccaggtcgggctggcggtcgccacgatcacccgggtctgcgggccgaagttcgcggcgacccggctgaagtaggcgagctgcgggtcgtcgatgtaggtggagtcctggtcgtccagggccagcagccaccagtcgccgggcagctggacggcgaagtacgaccggtgctgcggcagccgccacccgccgatcccggtccgccgggtgccggtgaacagccgcaggaacgcggtcagcccgtcgtaccagtcgtggttgccgggcagcgcgtacatggccggaccggcgccgtcgccgggcggggtgccgggcatcgccgcgtggtacggcccgaccagacggtcctcgtacccctgcgcgctcggggtcggatacacctcgtcaccgccgaggatcagcgcccgcccacgcggcaggtcgtgctcgccgaccttgaggctgggctgggccagcaggtacgcgatcgagtaggtggcgtggaagccgtcgccgaggtcggccacgaagtcgatccacgcctcgccgtccggcccggcctcgcggtgcacgtcgttcgggaacgacgcctgcagctcccgcttgtccaggtagccgccctggatgccggccagtgccacccgcagcccggtgccggccaactgcacgggggacagccaggcgaccggtttcgccggggtgaagccgagctcctgcggcgtgaaggcggccggccgccgggccggtgccgacatcgcctgttcgggtccgtgggtcatcagtgtcctcccctggggtgctgggaaaggagtaccagaacgcgaatcccggtcgcgcgggaggccttatacgctgggcggggcgccgcggaagggaccagctgagttgggcatcgaggacgatctgttcctgctgcgagcctacgagccggtggtccggttcaccgagggggagtggttcttcccggtctcggtcgacaggtacgtgagccgcgccggcctgtggcgggccgagcccggcgccagtccggtgcaggtggcccggcccggcgagctcaccctggaccggctggccacggccggcggcgccgagcagggcctgcggtattcgctgtccgggatcggcggggacaccacccaccacgcgcacatcccgctgcgggaacgcccgccgcacctggcccgggccagccggctcgcccaggtcggcctgaccgcccggctggtcgacgcgatgaaccggttctcgctgctgttccgcggcagcgtcccgggcggcagcgccgcgcactcgttcctgctgcagcgcgaccacctggagccgcaccgccccacctactacggccgggtgttccgcgaggagccgtggatcgtcctgcagtactggttcttctactcgttcaacaactggcgctcggcgttcggcggggtcaacgagcacgagggcgactgggagcaggtcaccgtctatctcgacggcaccggggtgatcgaccaggacggtctgccgccggcccgctgggtggtgttctccgcgcacgacgaggtcggcgacgacctgcgccggcgctgggacgacccggacctggccgtcgccgaggaccggcacccggtggtgttcagcggggccggctcgcactccggcgcctacctgcccggcgattacctgatcacggtccgcccgccgaagctgcgcggcctggtccgggcgctgcgctggtcggcgcggctgctcgcgccgtggtccggggaggaccggcagacgctcggcatcccgtacgtcgactatgcccgcggcgacggccgggcgatcggacccgggcacgacgagggctggcacccggtcctgatcggcgacgacaccccgtgggtgcgtgacttccgcggcctgtggggccgcgacacccgggaccggctcggcggcgaacgcggcccggccggcccgcgctattcccgcgacggcaccgtgcggcaggcgtgggccgatccggtcggctgggccggcctgtccaaggtcgtcccgaaccaggccgcggagcggcagctggccgagatccgcgcccggcgcaacgacgagcgcctggacaccctggaccgggagatcgacgcgctgcggcacgacctcgcggtgtccgcggcgggcctgccggccggcgctcccgaggtccgcgccctcgccgccgacgagcagcggctgctcgccctgcggatggaacgcacccggctggccgacgagcagagccggatggcgaccgtctggccggtcgtcgaggacccgcacgcgcacctgctgcaccgccgcctgccgatggagaccgccaccggactgctgggccgggcccgctcctggtgggcggtgctgagcacgccgctgatcctgtgggcgctgggcgcggtggtctcgccgctgccgatcgccggcaaacagaccgcgctgatcctgctgctcaccctgctcaccgtcgagggcctggtccggcagaagttctgggcggtgctgctgcgcctgctgctggccttcgtcgcgttgctgctgctggccctgctctggctggacggccgttacctggtgaacttcgcgttcttcgcggccgccctgctggtcctgctggtcaacatccgggaagcctggcgccgctgatccggggccgggcggctcaccgcgcgcgggtgcgcaggcggctcggatacaccagggtgcgccagcggcggagccggaaacgggccggccgggcgcaccgccaggcctgggccgcctcggccgcggtgcacggctgggtgccgtacaacgccttgtcggccagcgcggccagggtggccagcgcccggttgtcccggccgccggcggcggcgagcgcggcactgacgtcgaacggtgtcatcgtgcggatccgggccggcgcgagcgcgccgtgggccgcctcgtccagcacgtcgtgccaggcccgggcgatccggtcggcgggcggtccgccgcggcgccgccaggcccggcgcagcaccggcagcacgagggtgacggcgaggtatccgccgaccgtcaccgccgcggccagcagcagggtcacggtccgccgggccggtgcgggagccggctcggccaccggcggcggggtctgcgtcgggacgtcccgggtgacctcgtccggtggggcgcccgccggtggcggcaccgtgtcaccgggccggacggcgggcggggtgggctggtagtcgacccagccgggcccggcgtagcggagctgggcccagaccagggcgtccgccccgtacacggccccgggggtgtgcggctggaagccgaccaccagccgcgagggaatgccgagttcccgcatgagcagggcgaacgcggtggcgaactggaccgtggtgccgatgccgcgcggcccgagcagccggaccaccgagccggtgccggcggtcgcggcggcgccggtgacattgcggcgatgggtgctcagataccactcgaccgtgcgggcccgcgccgccgccgtcatgcccggctggagcgggacggaccgcaggaaggtccgcagggcggtgcggatctcggcgggcaccgccgtctccgcggcgtcgccggccgcggccggggcgacgatcggctcggcgggtgcggtgtgcggcaccgagccgatgtcgtaggcggcgccggtggccggccggcggtcggtgagcagcacgccgtcgaccgggtcgaccgcggtgaccggctcggtcacccgggccggccggtccgcggccggcaggtacggtccggtcagcgcgcccagcaccacgtgctgccggacgcccggctccgggccgcccgccggatagggcggcacgcccaggcccgccggtacgaaggcggccccggacgaccagctcacaccgtcgtaggtgtccagcaccgccagccgccaccgggacaccggatcgccggtggcggtgaacagcggaagcgtcggtgtggacagccagccggccacctggtccagcaggtcggcgctccggttggcccgctgcggcgcgacgaagtaccgccgcggatcggccgtgccggcgtccggcgtcgcgggcagccggaccagggcggcggccgcgatgaggagcaccacggccgcggccggcagcgtccgggccgcggccggccgcaggagcagcacgagcaccgccacgatgccgatcgccaacgggacggtctgccgggtcgagatccccgcggcgacgatgccgcacccggctaccgccagcgccgggatcagtgcctccagcccgccggtgcggcggcgggcgagggtggcaccggccgccgcggctgcggcggccagcacggtgggcacgaccgcgtaccgctcgggcagcggcagcgtgacccggagcgtttcgctcaggccgccggccagcacgtcgccgagcgcccgcgtgcggcgcggcctagctagctagcgtacggtgtgagcagtccggtgagtacggcggccgcggtgacggcggacgggacgtgcccgccggcgaacgccggggcgaaggtgagcccggcggcggtcgccgcggcaccggcggcgagccggtccaccagcgccccgatccgctcacgggtggtcatcggcgcagccatcggcgccactgcagcggcgcccggccgtcggccgccacgaggatcaggtcgtcctgcgcgaacagcggctgcagggcggctcggcgccccgggtccggcgtgacgacgacggtcgtcccggcccgggccgccgggcgcagcacccgggcgtcggtggtcggctggacggccagcagctgtgcgtcggcctcggcaccggccggccagacgcgtccggaggtggacagggcgaggctcgcgcccgcgcggcagaacgagaaggcgaggtcgacggcatcctcgaaaccgccggcctgcccggccggcgcgtggtggtcgaggacgacgaccaggctgtcggtcagcgtgggcgcgaactggcgggaatagagccggtcgtcgccggcgcgggccgacgcggcccagtcgatgtgccggacgtcgtccccgggttcgtattcccgcaggccggcgaacgcgacgccgggaccccacaggctcgcggcccggccgtcctcctgccggtcgacgaagggcggcgcggcctccagtggcagcagccgaggcatcacggtgacgtggaccgcctcgctggtgaacggcagctgccgccgccacaacgcgaacggatcgtgcacggtgaccgcctcggcgacgatgaggagacggccccggggcagcggcggactggtccattgccgcggggagcggccgatcggcagatccacccgctcgcccggggggtcgatgcgcagccggacgagcgcgcgccggtcggcggcgaccgagacgatgatccggtcgccgcgctcggcccgtgtcaccgcgcagcccagctccacccgggcgcccccgccggcggtcagtcggagcagcacaccggccgcgagcaggaccgcggcgagcagggcgacgacgagggcggcggggtagccgagcaggagccagccggccgtcccggcggcgccgcccacggcgaccagcacaccgttcggggtcatcgccgggcgttccgcggtcgggtgaccgggacctggccggtcgggacggtgccgaggatgctctccacgatcgcccgctgctccggcgcgccgccggggccggtcagcatcagccggtgcgccagcacgtcggccgcgacgtcgcggacgtcttccgggcgcaggtgcgcgggctgctccggggtgcccgcgggccgccggaccagcgccgagacgcgggccgcgcggaggaggtccacgctggcgcgggggctggcgccgagcaccaccgcggggtgcgtgcgggtcgcctcgacgacggcgagcaggtagtcgtagacggcgtcgctgaccggcagcgcggcggcctgccgggccatctcccggaagaccgacaccggccaggccgacgccgcgtcctccggccggtcgggcggcgcggcatcgggccggccgtgggtcttgagcagggcccgcgcggcctgccgatccgggtagccgaggctgagtctcatcaggaaccggtccagctgcgcctcgggcagcggataggtgcccaggctctccagcgggttctgggtgccgatcaccatgaagaactccggcaggtcctgctcgtgccggaaggcggtgacccgtcgctcctgcatggcctccagcaacgcggactgggtgcgcggcgaacatcggttgatctcgtcgaagaggacgatgttcgcgatcaccgggccggcccggaaggtgaagtcgtcccggccgcgctcgtacaccgaggtgccgatgatgtcactgggcagcaggtccggggtgccctggatccggttgaccgtgccgcccgcgagcagcccggcgagggccttcgccagggtggtcttgccgaccccggggcggtcgtcgagcagcaggtggccgccggcgagcaggcagatcaccgccttctcgacgacctcggccttgccgtacaccgttctgcgcacctcggcggtcaacgcggcgaatcgcggggagaagtcatcggcgatggccggcgtctgcccgtcgaggtgcatcgtgcctccctaccgccggcccggtggccgatcgggcccccacggtagcttccagtgaagatccgatggcggattgtcatccgatcgcacgccggagatcgaccgttccggccaccgcgatcgtccacatgggccgccgattccactcgtcagtggacgggtacggagcgtcggctgaccgtacagtggtcccggtgaggtgaccgaaatgacccatcaggaccgtcgcccgttccgccgtgcccaggtcacgccggccgcgctgatcgccgcgctcccggtcgttctgggcgcggcggtgttcgtgcacgggccggccgcacgcccggtgccggtgaccgaatcggcgaccatgtggctcgcgtccgcccggggtgcgctggtccgggccaacggcctggtgtcccggccggccgagcagatcatcgacaccgtgccgtacgccccggcggcgcacggcgtccacctgtccgcagaggtccccggcgcggtcttcgccacgaccgcgggacaggtgtcccgggtggacgtccgggccgggcgcgccgagcgggtcgccggtgacccggtgatcgccgccgggcccgacgtctatcaggtcggcgcggacaccgtcacccggctcgatccggccacgctgcgccccaccggcagctggacgctgggccggacggtcgccgtggccgccgggccggacgcggcgtacgtggcgacctccgccgggctctcccgggtcgacgccaccggcgtgtcccccgtcgcggatgagcacgccggcggcccggtcctgatggacggcgtcgccgacggtgtcgccgtctaccacccggaacgcggcgggatcaccgtggtgcgcggccggtcggccgcgaccgccgggacactcacccccgggccggccaccaccttcgccgccgcgccggacggccgggcgttcgcggtcgtcgccggccgcgaggtgcgggtgtgggccgccggccggccgtggagcgcgccgctcgccttcacccccggaaccggcgcgctcgccgacggccggctgtacctggccgatccggcggccggccgggtgcacgtgctcggcctgtcggccggcctgccggagcaggacgtgctcgacttccacgcgccgggccggatggagctggacgtgcaccggcgcgacggattcctgtggctcgacgacgtgcgcgggccggaggcctacgtcatccgggagggtcacgcccggcagatcgtcaagtatgtgacgccctcggcgccacccaccagccggtcggcggcggccaccaccgcacccccgccgaccacgacgccgccgacgaagccgccgcgctccccggatccgccgcgtccgtcgcggtcccgccacgacccgaagccctcggcatcgacgcacccctcccgccggcccgccacgccgagccggcccagcacgtcaccggccacccacccgagcacgcagacccccgacccgcgggcgaagtgtggtggccacgacgcctcgatcaccgtcgacgatgcggatcggaccgggccggacccgcgcgtgaccgtccgggtctgcgtcaaggccggtggcgaccagtactggatcgtcacccgcagcgagggtaagtggtacgcgaagcgtccggtcagtggcgcggtgggccggcagtcctacgtcgtgcacctgctgcacggctccggaacccccggccagcaccggcagttctccgtggtcgcggcccgctccccggaggcgcggcaggccctggccgcgaaccgggatgcggacatccagaacgccgactatccccgtgatgagctgcccagcggcgtggacaagatctccgcaccgtgcgagagcacatcctgagcccccgaaggagagcgccatgacgcatcgccggatcctcgccatcgtgaccggtgcggccctgctggtcgccgtcaccgcctgcgacgacaaaaccgagggggacgaccggcaggcccggccaccggccggcccggccaccaccgagctaccgaccggcacggccaaactgctcagcccggcggacggggcgcaggtcaaccagtgcgccatcttcaccggacaggcgaacctgccgggcgacaagacactggtgctgggcgtgcgcaacaccgacaacgggaacgccgagcgctacttcgaggcggtgaagaactgggagtaccccggcgacctgaaagcgtggacgggcgcccagtacttcgggtccaaggacagctcggtgggtcagcacttccgggtggagctgctcatcgtcgacctggggctggccaccaaggcgctgcggaacgcgaagacggagggctggcacgcgccggacaacccggccggcagcacgatcgcggcgcacatcaccctggcccgggtggccgggcccggtcccgccgagtgctcgtgacgcgcggccgcgccggtcagcagagttgatcggcgcgggtctgccggatctggatctgcgcggcccgctgcagtcccgccaccggggtcgcgctggtcgggtcgcgcttggccgcggcccacaccttgcggaccgattccaggtcggcggtcagcacgaccagggtgtacagctgtccgccgctgttgccgagcggcacgagcgcgctccaccggtccgcggcgtgcggctggtcccagtcggcgatccggaaataggtgaagagctcgcccgcataccggtcggcacgccggaccgcgaccaggacggtccggtccgcgggcagcgacgaggtcccggtcagcgtgacgcactggccgatcggcgttccgggtttcggcgcggcgaccgtcgcggcgccggtgagcgggccggtgacccagtccgggtcaccggtggcggccacggcgggggaggtggtgcccgcggtcgcggccgtcgtcgtcgtgccgggcggcggctgcgctccgctgtcgtcgtgcggccagagcgagatggccgcgaccaccccggccacgacggcgacggccgcgaccgatgccagaagcggccgcattcgcgagacgggagttcccggccgcgccggcctctcgacagccggcggtgccggcttcggcacgcccggcgacggcgggtccgccggtggcgagtccggcggcgcggacggacggcgcgcggcgacgatgatgccggccggctggatcggccgcagttcgtaccgcgcggacctcaggcgcgcggtcagctccggctcctcgaaccgggagacgatcaccaccagcgtcgcgccctgtttcaggagcgcgagcaggccggacaggtccgcgtccgcgtcgatcgggtcgtcaccggcgtccaggatcagcacgaaacgctcggcacggagccggttggacacccggccgagccaggtgtcccacggtgcggcggagaatcgctcgaagtcggcctccgggtacagcttgcgcccgatgtcgtgcacgatgtcccgggccgaccaccggcgtttccggaacgagtacgtgaaggcgcggcgggccaggtcggtgcgcacccaccaccaggcgagcagcccggcgaacgccgtcttgcccaccccggccgcgccgtgcagcagcaggctgttcggcgcgccggcgtcgaggagcagccgttccacggtgaccacgtcgacgtcgcgcccgaggacgtcgggctcctcacccgcgtgggtcagtgacgcgaaccaggactgtgcctgctcgtcggtcatctcctcgagctcgaggttcacctcacgctgctggaacagcaccggcagcagccagtcctgcaacgcgaacgactggtgcagcgcggtgcgtgcgttgtcgttgtacatctgcttgcgggccgcctggaccgcctggtcgggtcgcatgccggcggcgagcccgcggtagatcgtcgtcaccgcctgctcggccgcctcggcggagatcgagtacgccatgccgaccgctgccggcacgccggcctgggcgagacgctgcgccagcccggcctcgttgtcggagccctgcgccgactggcaggcgttgatcaccgcgaccgcgacgcggtgacgttccagcagctgagcgaccttgctggcgggaacggggtcggcgaccccggtggtgccggtctcgaagagcaggaaggcgccccgcccggtgaacggcgcgatcggctcgtgcgggcggagccggccggtggccatgccctcccgcagctgctcgtcgctgagcatccggccgtgcatgtcgagctgcatgacctggtagccgcgctgccggtccaggaccgcgggatcgtcgagatgccggaccaggccgcgccaggtgccggaccgggccagcccgacgcgcaccgggatgccggcggtccaggagaactccagcagccggcgggacatccgctggtagctgaggtccgccgcgccgtccggccgcgccgcgaccagcagtacgttgaggatcggcccgggactgggcaaccggaacggcggcttcatctcctgggcgtaccgctcgacgggcatctgtaccgagagcggctcgtcgtccggtgactcccgcagggcttcccagcgcaggcgatggaaggcctccgtcccggagatccgcaggcgacagccggcgaaccggttgtcgcggtgctcggcgtaccggcggaagatctcgccgtcgttgacccggctggacaacgtctgctcgaagaggtcgacaccgtagtcgacgagggcccgttcggtgcgttcccggcgcccgccggagtcgaccggcatggtctggtaggactcgaagtaccagtcgagcgcctcctccagggcggcgccccgccggtcggtcacggtgatggaggagacgccgtcgtagccgctgaaccgcaccgtcgcccggaacgacccgtcgccgagcacctgccgctccgcgatctcgatgatcgagtcgggcgcgctactcgccggccttgtcggtgacggcaatgatccgatcctcaccttcggccggcaggacgtccaccttcggccggtgtgcgccgccctcgggcagcagccggtccaggagccgggtgatgagcagcaccagcaggtcggcggcgacgttgacggtcagcgggatgaccacggcctgcagcggatcgaggtggtagccggtggggcgcacgtcggcggcatagggtttctcgccctcggcgagcagctcccgggcctcggcgtcggcggaccaggcctcggccaccacggcgggatcgatcgggaatccgggcgtgaacacgatggtcgcttgcggcacgctgcctccttggtgggccgttccgtccatagtgcccaccgtggggtggctcacgcatcacccgtcccgacgatcgaccgacccgggagtgccgtccgcggtacccttcgccgctgccgggccggcccggcagcggcgcccgacccgcaccgccgggtgtgacctgggcggtggagcctcaagacggcaaaggtccggccgaaaggaacggggtgcggcgatcggtggtgtggcggtggtggctggtggcgggggtgtccgtcaccggcggatgcgcgctgctgcccagcagcgggctggccgccaacctcggctacaacgcgatcggcctgctcgccgccctggccgtgctggccggcgtccggctgcaccggccggagcgggcccgcgcctggtactggctcagcgccgggcaggccgccaccgtcaccggtgacctgctctgggagtatttccagtacatcgcgcaccaggacccgttcccgtccgtcgccgacgtcttctacctgtccgcctatccgatgctggcggccgggctgtggctgctgttccgcggccggtcccgcgccggtggggtggtcaacgcgctgatcgccgggctcgggctggggctggtctactggatcctggtggtgcacccgatcgccgccgacaacgccgggtccgggctggccggggtgatcgccaccgcgtacccggccggcgacctgctgctgctggtcatggtggccgggctggtcaccagccgggccggtggcacggccgccgtgcggctgctggccgccgccgcgtcgctgctgctggtgaccgacggtgcggacgcggtggcgaccatgcacggctacccggaaggcgcgctcttctcctccgggtgggcgatcgcgtacctcttctggggtgccgccgcgctgcacccgtcgatggccgccgcgccgcaacccgccgccgcacgccccccgcgcgccggcagcgtccagtacgtgctgcccaccgtgtgtgcgctgctgcccccggcgatgctgttcctgccttgggtgggcggcaatcggctggaccgggtcgtgctcggcggcggctcggcggcgctgaccgtgctggccgcggcgcaggtcgccatgctgatgcgccgggtgcgcgggcaggccgccgagctgcgccagcaagccctgcacgacgatctgaccgggctgcccaaccggcgccggttcgagcaggcgctgcaccacgcggcgcggaccgggacactccgggtgatcttcctgggcctgaccgggttcaagagtgtcaacgacgagttcggccgtccggtcggggaccgggtgctgaccgtcgtggccggccggatcgccgccgccagccccgccggggccctgctgagccggctcggcggggacgagttcgcgctgctcgcgccggcggacgtgccggtcgaggagatcgcccggcggatcgtcgcggcgctcgccgccccggtcccggccggcgggcacgagctgctggccggtgcgaacctgggcctggccgaggccggtgagccggtcgaggcgctgcgccgggcggaggccgcgatgcacgcggcgaagagcaccggggagccgttccggcactggtcgccggcgctcgacgagcgggccggcgaggcagcgcggctcggcgcggagctgcgcgcggccctgcagggcgaccagttccgggtgttctaccagccgatcgtgcgggtgccggagggccgggtgaccgcgctggaggcgctggtccgctgggagcacccggtgcagggcatggtccggccggaccggttcatcccggtcgccgagcagaccggcctgatcgtcgaactgggcgcgtgggtgctgcgcaccgcgtgcgagcggctggtccgctggcgcgccgaactcgggccggacgcgcccgaccggatcagcgtgaacgtgtcggcgcgccagctggcccgaccggagttcccggacaccgtcgccgggatcctcgccctcaccggactgccggccggctgcctgaccgtcgaggtgaccgagaccgcggtgttcggcggcgggcaggcggtgaccgcgctgcaccggctgcgcgagatcggcgtgcggatcgcgctggacgacttcggcaccgggcactcgtcgctcgggctgctgcagaccgtgccggtcgacgtgatcaaggtggacaagtcgttcgtcgaccgggtcaccgagcccggccggcactcggtgatcgcccgcgcgctgatccaggtcagcgacgggctcgggctgaccgcggtcgccgagggcgtggagaccgcggagcaggccgaggccctgcgtgagctgggctaccacctgctgcagggctacttctacggccggcccgaggcggaaccggacctgctcagccggccggtgacagctgttccgctgtccgcgacgccggcgccgtgacggtgctccacccggtgacgaccgtccggcaggccggacgaggaagccgccgaccacggtccgcgggacttcccgcccctcgccgacccgccggacgcgtgtaggcgaatgcactccctgaggaacggccttcgggcgtccgcggactccgcgaatgcggtgcagttcagtgacaatgggaccgccgatcaccactggcagccgattccggacgggaatgtcaagctgcgggtgacgcattcgcagcaggcgccggcgatcaacgacatgtcgaccgcgaacggcgcgcagtcgccgcggggccggtggcccgacccggggctcgcccatccgcgctggcggatcatccccgcggcgctatgatgcgcgcgtggccgaagctgatgtgcagagttcgctgacacagatcagtaaggccgcggagctctacggcgtcaccgaccaggacgtcgaccgctggcgggccgacatcgaggaccgtccggcctgggcgcagcgggcccacgtctcgggaatgctggcccagcgcctggtgatgaccgcgatggagcaccgccagcagtgcacggtggaggcctgccgcacctgtgcggggctgcgcgagatggtggtgatcgcgctcgccggggtgcgcaccgtggtcgacgaccggctcgccgagctgtaccgtcgcccggcccgctggccgtggcggcgccgccgcttgtgatcagccgtttcacccattctctaagggaacgtttcaagttgatgaaatcggttcccgcgtcctcgttggacttgccagccaaggtcatctaggtatttactggcgtcgcttcggggatgccggtccggatcccattgaccaacgcaacgttccgctcagggtcgccctgcgcggtcattcttcatgcccgcagctcacggggctgtgagccgacagtggaaggggtgatgcagcagcatgtccatcgacaagttcggataccagcagcagttgcggcgggaactgcgtatccgcgacctgatcgcatacggtctggtcttcatggtggtgatcgcgccgttcggcatcttcggcggcgtgttccaggccagtggcggcatgatcgccctggcctatgtggtcggtgccgccgcgatgatcctcaccgcgtcgtcgtacggcgtgatggtggagaagtacccggtcgccggctcggtctacggctacgcgggccgggccatcgcccccgcggtcggcttcctcaccggctgggccatcctgctcgactacgtctgcatcccgctgctgctgtcgctggtcgccggcgccgccatgaactcgatcgtgaccagcgtcccggtctgggcctgggtcatcatcttcgtgctggtcaacacggtcacgaacgtgctcggcatcaagaccaccaagctgctcaactggctgttcctcgcggccgagctggtcatcctggtgatcttcctgatcttcggcctgaaggcgctggccgacggcaagggccacggcttcagcttcgacccgttctacaacggcaccagcttcacctggtcgctggtgctcggcggcgtctccatcggcatgctgtcctacctcggcttcgacgccctgggcctgctcgccgaggacgccgcggacggcgcccgcacggtgcgccgcgccatgtacctctcgctcgtcgtggtcgccgccctgttcgtcgcgcagacctgggtcgccgccctgctcgtgccggacccggccggtctgatcgccaacggtgacccggccggctccgcgttctacgacgccgccgaggtcgccggtggccactggctcggcaagctgaccgcgctggccaccgccctggcctggggtatcgcgaacaacatggtcgcccaggtggccaccagccgcctgctgatggcgatgtcgcgcgacggccagctgccgcgcttcctgtcgcgcgtctcgccgacccgctcggtgccgaccaacgcgatcgtcaccaccgcgatcatctcgctcggcatcggcctctggatggccaaccgcgacgacggcatcacgctgatgagcgccctggtcaacttcggcgccctgatcgccttcgtggtcctgcacgtctgcgtgatctgggagtgggcgaagaacggccggcggggcagcgtgctgcgcaacgtcctggtcccgctgctcggcgcggcggtcctgatcgcggtgatctggaacggcaacatcctcgcccagaaggtcggcctggcctggctcggcgtcggcgtggtcgtgctgatcgtgctgctggccaccgggcgcaagcccagcctgcccgaggtgcccggcgacgacgagccgctggtcgccccgaaagcggtcgagaatgtctgacgcgctgcacatcccggccgatcccggccagtacgggtacacgttcggcggccgcgaggcgatcgcctcgatcaagccgggcgacacggtcaccctgcgcaccctggactgcttcggcggcaaggtccgctcggtcaccgacctgcccagccaggtctgcgagttcccctacctcaacccggtcaccggcccgctccacgtcgagggcgcccagccgggggacaccctcgcggtgcacgtggtgtcgctgaccccggcctcgccggtcggcatctcgtcgacgttcccgcacttcggggcactcacgtcgaccggatacacgcgtacgctgcaggcgccgctcgaggagcgggtctggttgtacgacatcgacctggccgcgcagaccgtgcggtaccgggcgagccgcagcgacttcacggtcgacctggagctcgccccgatgctgggcacggtcggcgtcgcgccggccgcccacgaggtgcgtcagaccatcgtgccggacgtgcacggcggcaacctggacaccccgctgctcggcccgggcgccaccctctacctcggcgtgaacgtgcccggtgcgctgctcgcgctcggcgacggccacgcccggcagggtgacggcgaggtctgcggcgtcgcggtcgaggtggccatggacgtcaccatccgggtcgacgtgatctccggcgtgccgaccggcaccccgcgtctggagaccgacgcccagctggtgtcgctgggcgccgcccggccgctggaggacgcgttccggatcagccaggacgacctggtccggcacgtggccgccctgaccggactggacctgctcgatgcgtaccagctggtgtcgcagacgacgagcgcccgcgcgggcaacgtcgtcgacccgcagtacgtgatgagcgccggcatcgacaagaagtacctgcccggggtcaccgcgtacagcgggatccacgagcgactgcggaacggctgacagaagtaatcatgcgacgccccggactcgaccccaccctcgtccgcgagcagctgttcatcctggcgcacgacgagaccaggcacatgcggccgcgcctgcacgtgccggccctgtcggccggcctggccggcgcgacggtgatggacctgctgatcgcccagcgggtgatgatcgagtccgggacggtgcaacccgactggtatcagcgggagaccacgttcgacccggtcaccgacgacgtgctcgcgctgatcatgcagaaggcgcccggcccggcgctgcccggcctgatccgcgcgatcgcacccagcatgtacgagcgcaccgccgccgccctgatccacaagggtgtcctgctggagtccccggcgcggcgctggcgcaagaaggagtatgagatcgccgaggagggcatctcggtccgggtccgggcgaaggtgggttaccggctcgacggccgggacggcccctccccggacgccgactgcctgtgcaccctggtctcggcgctcggcctgcacgcggcgctgctgcgcggcacccgggccgagctcgaaccgctgatgcagcggatcagccgtgacctgccggaccgtgcccgccccacccggcacccgatcggcggcgccccggcggtcgccgcggccgtgctcgccctcgtccaggatctggccacctcggcgatgtgagacacgtgcgggtcagcggtgccggccggccttgagcatctcgacggtctcggcgacccgctgcgcgcgggtcgcctcccgtttcgcctcaccgatccagcgcgcgaactctttgcgatgcgaaaaggccagtcggtcgtacgcggtctgcgcggccccgtccgcggccagcgcggcggccagctccgccgggacctccacggtgcgttcgccggcgtcggcggccaccgtcacctcgtacgccgtgccgatctccaccccggcctgcgcccgcgccgccttggccaggccgatcatgttctcgccgcccatccgggccagccgcagcggcagcgtcaccccgttcaccgtgagccgcaccgggaacgccttcctcccgtcgccgacggccgcgacctgctcgtcggagagcaggaacgcgcccgccgggccacgtttctccagggtcagggtgagtgtcaggatctccgccatgctgacacggtagtcagtcgtggtggtgatccgtggagaacgcccgcgccagcatcgcggcgattcccacgccgagcaccgcgatgccgacctgcacaccgaccacggcccagtcgaaggtccggccggacaccgtgaagaagtgcgtgctgtgcaggtcgtaccgcttggacacccaggtcccggcgaccgcggcacccatcccgaccagcaccgtcgcgatcagcccgatgttctgccggccgggcagcacgatccgcgccaccaccccgatgatcgcgccgaagacgatcgcggcgatcaggttctgagtgttcactgacttcctcccaaggacatcgcgtcgatgcccatggtgacggccgcgtcaagcctggtagtcaccgcccggctgccgggtgatgacgttcagccgattccacgcgttgatcaccgcgatctgtgcggtcagcgccgccagttgctcggcgtcgaagtgctcggcggcggccgcccacacctcgtcgcccaccccaccggccgcgtcggcgatccgggtgccctcctcggccagctccagggcggcccgctcggcgtcggtgaagacggtcgcctcccgccagccggcgaccaggtgcaggcgcaccggcgactcgccggccttggtggcgtccttggtgtgcatgtcgatgcagaaggcgcagccgttgatctggctggcccggatctccaccaggtgccgcacggtttccggcagcggcgactcggcgatcgcgcgggatgccgcgaacaggtgcttggcgacctggccgctgacgtggctgccacggtggtccagacgtgcgttcatgatgccgtgctccctaccttgtgggctgtgcggttacacggacaggactggacagccgctccggatgtgacagcccaccactgtgatcgatgccacccggccgtggtggcgttcaccgccgggcgctgcgcggctcagtggacgtacggccaggcggacgagtcccagcccagcaggttgatgccgagccgggcgtcgccggccgacgtgtagtagtggtagagcagcacgtcggagtcgctgtcggtgaggacggcgggatgcccgggcccgtggatcgcgccgtgcgaggcgaggatctcggtgccgccgccggccgtggtcagcgtgccggcccgatcccggtacggtccggtgatcgacgtggaccgggccaccatgatccggtacgtgctggacgcaccccggcagcagaagtcgaacgccaggaagaggtagtagtagccgccgtgccggaagacgaacggcgcctccaccgacttgctgttcacgaagcgctcggcgacggcgtccatcgtgctgtcggcgcgcttgccggtggccgggtccagcctcaccctcttgatcccggaccagaacgaaccgagggtgagccaccactcgccggacggggtgacggtcagatcggggtcgatggcgttccagttcccgccggccgtggactcgatcaccttgccatggtcggtccaggtgccggctgcaccggtcgggctggcggccaggaagatcgccgaccggctcgagccgaacgtggaggcggcgtagtacatcaaatacctaccgctatggtacgaaatatcgggcgcccagagtgtggcgctgccgccggtgtagtcgttcgcccacggcgtcccggtcgggaaggccctgccggcggccacgaacctggtgcggtccgaggaggtcttcaaggtgatcccgtcgccggtggtggccagcaggtagcccccgttcggcgtcttcaccatggatggatcgtgggcggccgtcgagccggtgaccacgcccggatcggggtaggaggcggcggtggccggcgggacaccgacggtggtcgcgaggagcgcggacagcatcagggtgcggaagcgagacatggggggattcgccttccggtctggggtggcggccccgatcggggaatcggggccgccgggggacggtggcgttcatcgatgtcgattcgattgcgagcatgttaacgctcacacccggcgcctccgcaagaggctcccggaagaacgtcaccgggcgcccggcagcgctacgtcgactgcatccaccggtgccgcgccgacctcgacccggcgtcgtcggtcaagccggctgtgcggcgccgcgtgaccgctgtctggtggtccccggacccggccctgctgctcggcctgatgctgaccgagccgcgtcagctggtcagcacgaccagccgctgagtggcccgggtcatcgcgacgtagcgatcgacggcaccctcgacgccgctcccgaaatcatccggatcgatcaggatgaccaggtcgaactccagacccttggccagggccggggtcagtgagcggacccggtcgcgccgctgcccggggaatccggacgggccgatcacacaggcgacgccctcgtcgttcgccgccagccactgcgtcagaatgccgtccagctcggcggtgtgtccgtggacgacgggcacaccgctctcccggatggaggtgggcacattggcgtccggcagggccgcccggatcaccggctccgcctccgccatcacctcggccggggtccggtagttgatggtcagcgaggccaggccgatccggtcgaaaccgacccggcgcagccgctcctcccacgactcggtgaagccgtgccgggcctgcgcccggtcacccaccacggtgaaactccgcgacgggcagcgcagcagcagcatctgccactccgcgtcggtcagctcctgcgcctcgtcgaccacgatgtgcgcgaacggtccggccagcagatccggatcggccggcggcagcgtgccgccctcgtcgagcacctcccgcagatcctgctgacgcagcatggtcatcaggccctcgccgtcgtcgtactcgttcgacgcgatcagatcctcgaccacccggtccatgtcgcggcgcccggcggccagggcggccttctgccggcgcgcccgctcgtcggccgaggcgtcaccgagccgctgccgcgccgcgtcgagcagcggcaggtcggccaccgtccacccccgcgggtcggcccgctgcagccgccggacgtcctcggcgcccagccagggagcgcacctgcgtagatacgccggtaccgaccacaggtcggcgaccagatcggcggcgtccagcagcggccacgcccggttcagcgccgtgcgcagctcccggcgcgtctcggtgtccggctcgtccaggacggccagcaactccgcccagatcggctcccgggcctcgttgtgcggggtgcccggatccggggcgtcgaacgcggccgcccaatccgcgcggctccccaccgtgggccgggccggcggctcctcgtagaacgcgaccgccgcctccatcgccccgaccaggccggccttcaaccgggccacctccggatcggactcctcggccgcggcggcgccctccggcaccaggtcccgcaccgtgcacgtctgcacatcgtcctcgcccaggctgggcagcacgtccgacacgtacgccaggtagggctcgtgcgggccgacgaacagcaccccgccgcggcgcgcactcatccgcggatcggtgtacagcaggtacgcggtacggtgcagggccaccaccgtcttgccggtgcccggcccgccgtccacgaccagcgcaccgcgcgacccggcccggatgatcgcatcctggtccgcctggatggtgccgagcacgtcgcgcatccgcggcgaacggctggtgcccagactcgcgatgaacgccgactgatcgtccagggccaccgcgccgtccagggcgtccgcccggtagatctcgtcccagaagtcgatgatccggccctcccgccagcgataccgccggcggctgaccagacccatcggattgccgtgcgtggcgccgaagaacggctcggcggccggcgaacgccagtcgaccagcagtcggccgccctccccgtcggtcagcccgagccggccgatgtagaccacctcacccgactcgtgcaccatccggcccaggcacagatccaggctgaaccggcgcagcgcccgcaaccgcgacgccatccgccgcaccgcgtcgtcccggtccacggcctgacgccccttgccggccggagccttgcgctcggcgtccagccgctgctgcagatcggcgatcgacgcgccgagactcccggcgatcgcggcgaaatgcttctcgtccgcaccgatcagatccgggtcgtccttcgccggatgcctacggagatcgaaaacatgcacctgcgagttcccccgttttccccgctcgccgcgttgacttcagcgattctgccggggcgccggggtcttgccgcaagccccagggtctgctataggttagaagtgggagggagtgtgttctccccttggcttctccggacatcgcccggatcctcgcctcccctcgcctcgcctcgcctcgcctcgcccgctcggcctcacctcgccttccctcgcggacgcggacaaccatgctgccgccccgacccgccctgcccgagatcgacgagcgcgtttgccactcgcatcgggctgacatactggcgggctcctgacctggggagcgcgtggtgacactgatcgaactggaccgcgagccggacgagcgggacttccagaaggcgtgcgcggcacccgttcagtagccgcccagcaggacgaacagcagggccagtgcggcggggacggtctgtacgtacaggatcctccggctcgcggtggtcgcgccgacgatgccggcgacggcgacgcacaccaggaagaagatcttcgcggcgaagcccgtgtggccgccggcgatcaggccggcgatcaggccggccgccaggaagccgttgtagagaccctggttgaggccgagcacccgggtctgctcggcgaactcgggagtcaggccgaacgccttgcggccctgcggtttcgtccacaggaccgtttccagcacgacgatgtacatgtggatcagcgccacgagcccggtcaggacgttccccacgatgatcatggcggtgaggttaccggccggtcaggtgccgcagaaggtccggtacggtccgaagtcgtcgggcgccggctccgcgtatcgttccaggcccggccgtgaccggaacggatcagagaccgcctcgaccagccggtgcaccggggtcagatcgccgtcggcagcggcggccagcgcctcctcgaccaggtgattacgcgggatgtagagcggattgacccggtccatcagatccgggtcggggccggccgcccgccagcgctccagccacgactcgaaaccggccggcgccggctccgcctccccatgggccgcgccgcccagcaccgggttcgtccccccgcgggccgtgccggccagcaccgggttcgtccccccgcgggccgcgccggccagcaccgggtccgtctccccgcgggccgcgccggccagcgtccggaagaagcccgtgtagtcgacccggcccgcccgcagcagcgccgcaacatcggccaccagcgcgtccgcgcccccggacaaccccagcttggcatgcatcccggccgaccacgccgcgtcgaaggccggcccgaacccgcgcagcgcggccactgccatctcgatcgcctgctcctcgtcgtcgtgcagcagcggcagcagcgactcggcgaaccgggccagattccactgggcgatcccgggctggttgccgtacgcgtaccgcccggcggtgtcgatcgaactgaacaccgcggccgggtccaccgcctccatgaacgcgcacggcccgtagtcgatcgtctccccggagatcgtcatgttgtcggtgttcatcaccccgtgcacgaacccgaccagcatccactgcgccaccagcgacgcctgcgccgccaccaccgcgtcgaagaacgccggatagtcacccgcggccgccggatggtgccgggcgatcgcgtggtcggcgagccgccgcagcagccccggatccccgctcgcccgggcgaactggaaactgcccacccgcaggtggctggccgcgacccgggccagcaccgccccgggctgcggctgctcccgcagaatggtccggccggtcgcgaccaccgccagcgaccgggtggtcggaatgccgagcgcgtgcatggcccggctcacgatgaattcccgcagcatcggcccgaccgccgcgaacccgtccccgccccgcgcgaacggcgtccgcccggaccccttcagatgcaggtcacggtcgccgagctcaccgagcagcagggcccgcccgtcacccaggcgcggcgagtacccgccgaactgatgaccggcataggcctgcgcgaccggtttcgccccggccggcggcacggtgccggtcagcagtcccagaccggcctcgccgcgcaaccagtccgggtccaggcccagctcaccggccagttcctcgtcgagcacgagcagccgcggctccggcgcctccgcggcccgccaggcgaccgccatctccggcagctcgtcggcgaaccgatgtcccagcggcacgatccggtcggcaggtttccggtcggcaggtttgacgtccacctttcgaaagtagccgcgccggtcccgcctcatcgcgggcccgcggggcggccaatctcacaccgtgccgacacgccgctgcgcggcagccgccaggcggcggggaacaatggcggcatgacggaaatccaggtcagcggtgcggttccacgccaggcgcgggccagggccaccttcctcgggtacgccatgaaggccctgcgcagcctgccccgcccggttcagcgggcggtcctgaacggtgccgccgcgggtgagctgcccccggtcgccgacttcgtgcggatgctggagatcgccggtgacctgccggagaccggccccacccacgccgaactgctcgcccgcttcccggccctggccgccgtcgaggtgaccgacccggccgtcgacggcgtccccgcccgcctctaccggcttcccggccaccccgccgaagcggcgctgatctgggtgcatggcggcgcgttcgtccgcggcgacctggcgatgccggaggcgcactggaccggcctgaccctcgccgcccgtggcatcccggtgctgtccctggactaccgcaaggcgctgcacggcgtccgcttcccggccccctccgacgatgtcctcaccggctggtcgtgggcggtcaaccacccgtcgctgatcggggtgccggcggcgaagatgcacctcggcggcgccagcgccggcgcgagcctggccgccggtgtcgccaagcgtctccgcgacggcgagggccgcccaccggccacggtcgtgctcgcctatcccgccgtccacccggagctcaccggctgggacgagccgggcctggccgcgatccgcgacaaccactccgcggtgtacttctcgccgggctggatccgcgacctgagcgcccactacgccggtccggaccggctcaccgacccgtacgcgttccccggcctcggcgacctgaccggcaccccgcccaccctgatcgtcaactgcggcgccgacaccctgcgccgctccggcgagctctataccgagcagctccgcgccgccggtgtcgcagtgacgtcccacctgctgccggacgccccgcacggcaccctcaacgatccgttcagcgacgccggtgtccgcaccgccgacctcatcgccggctggctcgttccgaaatagccccgggccgggacagacgccgggcctgatcgactagtaacgtgccgggctcacaggtttgttccagcaacgaggtgaccatgtcccaccccagccccgccgacccctccggggcccccgccactcccgcggccgccccggcctcggcagcccccgcggccgccccggcctcggcagcccccgcgtacccgggtggcttcgccgcccccggtgcgctgttcgcgaccgaccccaccacgggcgcgccggtcggcttcccggccccaggtcagcccgcaccgggcgcctacgccgcaccgggcgcctacccggccgcgcagcccgtgcagaccatcccggccccgtacgccggccagccgggcgcctaccccggtgcgcagcccgccgcctacccggccccgcagccgggccagcacatccccgccccgtactccggtcagcacccgggctacccggcggcccagcccggtctggcgccgcagggcatgctcgcctgccgtttctgcggttcggtcccggccgcccaggtcaagttccgcggtcaccagggcctgctggtgatcatgcggtttctgcacacgaccggcccgttctgccgggactgcggcctcggtgtcttccgccagatgacctcccgcaccctcgtgcagggctggtacagctacggctccttcgtgatcaccccgatcaccgtgctggtcaacctgttccgccgcaacacggtcgccaacctgccagccccgcagccgaaccctcacggccccagccgcccaccgatggacccgggcccgcgcctgctggagcgcccgatgacctggctgggcctgctgatcccgttcgccctgatcgccttgctgatcttcgcggcctcgcagaactgaccgccctgccgcagagccggccgcccctgtcgtaggacttaccaccctgccgcagagccggccggccctgccgcagagccgaccggccgggccgcagaaccggccgacccggccgcagcgcgtcctagggtctgtatcgaagtgcgttaaagccattcgttgatcgcggcgattgtcacggtggtctcgtagcggacggcgagtttgtcgtaccgggtggcgacggcacggttgcgtttgagtcggttgatgccgcactcgacagcgtgccgctgcttgtacaactcggggtcgaacgcgggtggccggccgcccttggaaccgagcttgcgccggttggcgtcctggtcggccttgctcgggatggtcgccttgatcccgcgccggcgcaggtagcggcggctagctagctaggttagcccgagaggtgtaagccttgtcggccagcacccggtcgggccgtgaccgcggccggccaaccggccgcggcacccggacgccttccaagaccgcgatgaactgcggactgtcgccacgctgaccagcggtcagcacaatcgacagcggtttctggccctgctcacaccccagatgcagcttcgtggtcagcccaccccgagaccgccccaacgcatgatcggccggctcggcgccgatcccacccggcggttcaccctgcagatcccccttttacgcgcaccagcggcatgctgatgcgcgcgagcgacggtggagtccaccgacacgtcccagacgatccggcccgcctcgtcggctagcgattgcagcgcggtcagcagccgcgcccaagtcctctctcgctgccagcgccggaacaacgcgtacgccgccgaccaggatccgtacaccgacggtatgtcccgccacggggcaccgacccggatccgccaccgaatcccatcaatgagctgccgtttcgtccactgcgacggccggccaggcctgcgaccggcaggcagcaacggctccagcaccgcccactgcgcctcggtcaggtcgtgccgccgcgtcaccgctaaggtgtccacgaggtctccggtggtctccggttttgcttggtcgctaaaccacctaccggagacctcgtcttctatcgatcaacgacgcgcgtgacttccaccgccaccgaccgacttcgatacacgctctaacggcccatcccgtcctcgatcgcccagcgcaggaagtcgtacgtcgcccggccgcgctcggccggatcgtcgtagagcgcgggcgcctgcgggcgttcccggatgcgcagagcgtcgagaccgagccggtgccatcgtgcgtccaactccccgacgacgtagcggccggcgccactcttcgaggtcagcgagcccttggcgagcaggtgatgcagtcgggcgacaccgagcaccacccacgcgacggacggttcgtgtccgccgaccgcctcgaatcccgcctgttcgatctgcgggatggcggcacgccagtacgtgtccaggttgtcgcgggtgaagtcgtgcagcaccgcggggtcggtgtggacgggcggcagctcgccgcggatcacgacagcgcgttcggccagctcgtgccaggtgaccgggttgatgtcacccttgcccagcgggtcgaatgcgccgtcgaagaaggccggccgacgccccaccgtcaacgccgagacggccaggtcctccggcgagcagtggaaaccgtcgaacgtcgcgtcggggtgtcgcgccctggtcgcgtggtgagccgcggcgagggcgtcatggtcgggtggccgggcccagacgccgacgaagtccacatcgctgccggcgaagaactcgccccagcagagcgaaccgtgcaggaacagcccggcgagcgcaccgggctggcgagcatcgacttccgcgagaaaggtgcgggcgacatccacggctcggcactttagccccgaccggcaaggcgccttagcgccgaccggcaaggcaccccgggggagccgctcaggactcctcgaccgcggcgatgtatttttccgggtccttgttgtggaagtccagccccttgccctgcgggtgctcggcgaagaaccgcaaccatcgcgcccccagttccagccggagctcccggctcgcgtgtctgcggaagtcgggcagcacctcgtcctcctcctcggcgaggtgctcgctgttctccgtgcgcgcctgccacaccccgccccaccactcgtcggatccgaccgggtgccgggccgcctcggcgatcccgtcgcggatcttgttgtggtcgcggatcgcgtcgtcggtctcctcctccgcgtcgtcaccgccgctgtcggtgagcaggtgcgggtagaggatctcctcctcggcctcggcgtgaatgtcgagatgcagcgcgagcggctcccacaccgcccgcagctccgcctcaccggaggcgtcgtcgagccgcgcgaatccgagccggaacctgtggtgatcttccatgatcagcgccgtgatgtcgtccatgcgcacgacagtacgaccgatcacgacgctccgctcgaccctgtggacaaccccgacccggcaggagaccggtcaggcgcccgcgtaccgcttgatcagctcggtggcctgtccggtgatgtcggcgatcacctgcgggaattccgcgaccacccggttgcgcagcacccgcatcgggttgaactccggcgtctccgggccgaagggcgaggtccgcacggtgtctgtggcctgggcgttcaccagtaccggtgacgatggtcgatggcggccggccggactgtcggccggccgaccgtcagaggaattcgctgcggtacatgtcgatcagctcgcggtagttcggtccgatgttcgccacgtacacctcgtcgaagcccgcctcctcgtacgccttgagctgcgccgcgtgcccggccgggtccggaccgcagacgatcgacttgcgggtcatctccggcgtgaccagctcgctggcctgttcgaagtgccgcggggagggcagcacctgggacagttcgccgggtacgccggcgttcgcccacagccggtgcgcgatctcgacgccctgctcctcggtcggtgcccagcagcccttgaagccgccctgcacgggtttgtcgccgccgcccgcctcgcggaacctggtgaccaggtcgccgtcgggcatcaccgagatgtagccgtcgccgatccgggcggccacgtcgatcgccttcgggccgaacgccgacacgtacaccttcggcggttgcgccggccgggtgtagatccgcgcctggtccacctcgtagtgccggccccggtgggtgacgaactcgccggtccacagctcgcgcatcaccgcgacggcctcctcgagcatctccagccgctcgctcgtcatcggccaccgcatgccggtgacgtgctcgttgagcgcctccccggtgcccacgccgaggatgaaccggccttcgtgcatgaccgcgctggtcgccgccgcctgcgcgatgatcgccgggtggatccgctggatcgggcaggtcaccgcggtggtgatcggcaccgtcgccacctggctgagcgccccgatcaccgaccagacgaacgagctctgtccctgggcgtcgttccacggatggtagtggtccgagatccacagcccctggaatccggcgtcctgcgccagctccgcctgctcgatgagctgggccggcgtgtattcctcactggacaggaaatatccgatacgcatgccgtccggataccccggcgccgcccgccgaatcgtcggccgcccgggccagtgcccgcagcggctccgaccaggcccgcgggtcggaccagcagaacgtgtgcgggccgggcacctcggcgtaggagccgcgcggtgccagtgcggccaggtggcggccccaggcgggcgggctgatcgggtccaggctcgcgccgaggaccaggaccgggaccgtcaggcggcgcaccggccggcccagcacgtgccgcaggtgcacgcgcagcagatgccggtagcggcgcgggccggtccgtcggacgtcgcgcaggtgcacccgggccaggctcggcgactcccgccacaggtcggaccagcagcggcgcagcagcctcggcagacttcgtgcggccgggtccgggaacgggcagaccagcgccaccgcgaccaccgaggggctgcgcagcgccgcctcggcggccacctgggcgccggaggactggccggccagcaggaccggcccggtccggtgctcgtccagccaggccgccacgaggtcggcgtactccggcacgtcgagctcgtgcggcgggtcgtcgctgccgccgcagccgggcaggtcgatcaggtgtgcccgggtccacccggccagggcgcgggtggccggctccaggtagtcgcacacgcccagcccgtgcaccacgacgacctcgggcacgcccggccggtgctgcccctcggtcctgctccggatcgccaccatgccgggcgcaatacccccggcggtggccgcgaatcagcggtgcgcgggggagcggcgcaccctcgtgtcgaacaggccgagcagcccggtggtggccagcacgccgtgcaccacgccgcgggcgttgaccacctggtagccgcagtgctgctgcagggccgcggcccggccctcgaccagggcgcggatgccggcggcggccaggaacgggacccgttccaggtccacgaccaggctgctgacgccgggctgggcggcggcgttcgccacgatggcggcgagcgcgtcgctgacgtcgtggtcgatttcgccgcgtaccgcgagccggatgacgccgccaccctcgtcgtgcttgctgaccgcgaacgttgctgtcattccctgtaaccgtccgagagaagtgtttggcgccgatgatgaccgaccggggaccaccggggcggacttgtcaccctaatcgcggtgcggcggttccgctcggattaggcgtttcggccgatgacgacggggaaaccggtcagcatgccgatcctcaaccgcctggaagaagcccgccggctcgacggcgtgagcgacaagctgcagtccgcggtcagcgccgcggtccgcccgcaacggctgcgtgacctgctgcacggcacctggctgggtcatccgctgcacccggtgatggtgcaggtgccggtcggggcgttcgtctcgaccgcgatcctcgacctgctgcccggcgtgcggcgggcgcagcagaccctgctggccgtcggtgtggcgaccgcggtcccggccgcggtggccggctggacggactggtcgcagatgacccgggaccgccgccgggtgggcctggtgcacgccggctccaacgcggtcgcgatcggcctgtacgccgcctcgctggtggcccggttgcgcggccggacggcccggggcaaggcactgagcctggccgggctgagcgcggcggggttcggggcgtatctgggcgggcatctcgcgtacgcgcagagtgccggaaccaatcaggcggcgccggacctggcgcgcctgcccgaggagtggaccgaggtctgctcgctggcctcggtgccggagcggcggaccgtggtgcggctggccggcgacgtgccggtgctgctgtaccggatcggcgaccgggtgtcggcgctggtcgagcggtgcggccacgagaccggtccgctgggcgagggcgacgtgaccggtgccggctgggacgcgtgcgtggtgtgcccgtggcacggcagcacgttccggctcgccgacggcgccgtggtgcacgggccggccgccaacaaccagccggtgatcccggtccgcgtccaggacggccgggtcgagatccgccggccgtgagcccccgaggcgaaggaggagaatccatgcccacccgcgacgagatgccgtcgacgctgcggcgttccccgaagaaggcgcaggacacgtacgtcgcggcccacgactccgcggtcgatcagtacggtgagggggaacgcgcgcaccgcaccgcgttctccgcggtcaagcactcgttcgagaaggtcggcgaccactgggagccgaaggcgaagaagggcccgagcgacgcgaaggccgccggtggccgggacacccgggccgagacggccggtggggtggatgccaacgccagcaaggagcacctgctcgacctcgcgaagcggctcgacgtcaccggccggtcccggatgaccaaggccgagctggtcgacgcgatccagaaggcgaacgaccggagcacccgcaaggcccgctcctgaccagcctcggcgggctgccggtcaggggaccagcagctcgcccaggccggagatggccagcacccgggccacgtacggctgcaccccggtgatcagcatccgcacctcgcgctgccgggccacctcgtacaccgcggtcagcatcccgatcccggccgcgctcagcagcgggaccccggacaggtcgacggtcagccggcggccccgcccgcaggtgccggccgcggtcatcagatcgcggcgcacctggttggcgttgtcccggtcgatctcgccgcgcacgtcggcccgcaccccgtccggcacggcggtggccagcaccaggtgttccggggcgccggcgccggcccagggcggcgtcacgtcggtcagcatcgcctcgcgcagccaggacagggtgcggctgagcagccgggacacgtgcatctgcgagatgcccagttcgtcggcgatctcgacctggctcaggttgccccagaaccgcagcgccagtagccgccgctcgcgggccggcagctcgcagagcaggctttcgacggtggtccggtcgtcgaccagggacaggtcgccgtccacgtcgccgatcaggtcgccggcctcggagccggtgtcgccgagcggcacgttcagcgattcggtgttgtgcgcggccgcggacgtctgcgcgccgcgcacctgcgtctcgtccaggccgaggcgttcggccaactcggccaacgtcggtgtgcgggccagttcgctggtcagctcggcgcgggcgtgcacgaattcgagcacccggtcctgctgtccgcgcggcacgtgcaccccccaggtgtggtcccggaagtgccgtttgatctccccggtgatggtcaggatcgcgtacgcggtgaacgatccccgctgtgggtcgaaccggtccaccgtcttgatcagccccagccgcgccacctgcaccaggtcgtcggtgggctcgccgcgtccgcggtagcggcgggccagccgtccggcgaacggcagcgcctcccggacgaagcgttctctcagtcgccgctgttcccggcagtcggcgcgttcgcatgcgtgggcgtacctgtcggccatcaggtccaggtcttcaagtggttccagccggtccaggtcccgcatgggacaacccttcgttgagaccccgcacgggtccgacctacccactgtgccccaggaggatgccccgaaacccggcaaccgtccgggttgccttctggtagtgcgtgcgttcagggccgaagcgatcccggcccgatgcccgaagagtctgacggcgccgaggtccggcgtcgtcacctttcagggggtatcgccgctttggcaccgatgttcgcaccgctccgggagcgcaactaccgcctctgggccaccgccgacctggtgtccaccgccggcacgtggatgcaggtcctcggcctgaactggctgatcctctcggacaccggctcggccgccaccatgggcctggtcgtcatgctgcaggccctgccggtcctgatcctgggcacctggggcggggcgctcgccgaccggctgccggcccgcccgctgctgatcgcctcgcaggcggtccgcgcgctgctcgccctggccctggtcgcgcacggcggccacccgctgatctacgcggtggcgctcgcctccggggtgatcagctcgttcgagggcccggccctgggccggttcggctccgccctggtcccgccgtccgcgctcggctcggcgctggccctcggctcggtgctcagttcggccggccggatcgggggcatggccctgggcggcatcctggtcggcgtcaccggcccggccgccctgttcgtgatcaacgcggtctcgtacctggcggtgatcggcgccctgtccgcgatgcgcaccggcgagctgcgcgacctgcccaccgccgctcccggcgagcgcggcatccgctccggcctgcgctacatcgccggtcagccgatcgtcctgatcgtgctggcgctgtccttcgtcctcggctcgctgggccgcaactaccaggtcagcatggccgccatgacggccggtccgctgcacgccggttccggcgcctacggcctgctgtccaccgtcttcgcggtcggcgcggtcctcggcggcctgctgctggccggctccggccgctccaccctgcgggtgctgctcggcaccggcctcaccatcagcctgctgcagctcggcgccggcctggccccgaatctcacctcgttcgccgccctgatcctcccgatcgccgccggcgcggtcgtcttcgacaccgtcgtctccacccggatccagctggacacccgcgaggacatgcgcggccgggtgctggccgcggtcggcatcgtctcctccctgtccgggatgttcggcgccccggcggtcggctggctctgcgacaccgccggcccccgcggcgcgctgctgctcggtggcgcgatcaccaccgccgccgcgctggccggcgcggcggccgtcgcccgcgccaccggccgtgggctgcacctgccggagcccttcaccccggcggagcagatggcctgatccgcacggtgacagtccccgctcgggtgagcggggactgtttcgtcgcgacccgggtatgccccgccccatgtccgtgatcaacgcccaggacgtcgaaaccgacgaggtcaccgtggtggtcgccacccgcaaccgcgccgaccggctccgcgacaccgtcccgcatcaccgagcgccgacgatcatcgtcgacaacgcctcggaccagcccctggacttccccggcgtggtccggcttccggagaatctcggggccgccgcccgcaacatcggcgtcgagctggccaccaccccgtacgtcgcgttcgccgacgacgactcgtactggcagccggactccctggcccaggccgccaagatcttccgtgcccacccccggacggccctgctgacggcccgggtgctgatcggtcccgaagcccgcgtcgacccgatctcggacgagatggcccgggctccgctcggcaccgcgccggacgcccccggccccgcggtcctcggcttcctgtcctgcgccacgatcgtccgacgcgacgcgttccttggggtcaacggctttcaccccaggctcttcgtgtacggcgaggaagccctgctcgcgatggacctcgccgccgcgggccatcatctcgcctacgtgcaggcgctgaccgtccgccacttcccggagccggccggccgtgacccccgggcccgcctgcgccgcgaagcccgcaaccgggccctgaccgcgctgctgcgccgcccgccacgagtggtcgcgacgaccctggccgaggtcgcccgcaccgagccggcagccctgctggacgtcacccgggacctgccgtgggcgctcacccatcggcgtccgctccccggcgaggtggaggcggccctgcgccgcctggaaagctgaccgcccggttccgggcggggaggaccctggcgcagggtgcccccgcccactccggagcgaccgctaccatccgccggccggcgcggccaggtgcaccaccttcgtgcaggtcatctcgtcgagcaactccggcccgtagccgaacccgctcccggagaacccccggggctgagccgcgccccccggcgccccgccgaacaccgcgttgatcttcacggtcccggccggcagggcacgccatgccgcctgggcgttgctcatcgacggcgtcaggacggtggccgcgagaccgtagtcggaggcaccggaccggcgcaggccgtcggcgaacgagtccaccaccatcaccggcgccaccgggccgaacgtctcgtcgcgcatcaccgccatgtcgtcggtgcagtcggagagcacggtgggcggatagaacgcccccggcccggccggtaccgccccgccgcgcagcgccaccgcaccgtccttcacggcccgctgcacctggtcgtccaccgccgcccgcaaccgccggtccaccagtggcccgatccgcgacccccaggcctccgcctcggactccagcgccgccaggaactccccggccaccgcccggtgcacgtagatgcgttccaccgcgacgcagatctgccccgagttggcgaacgcgcccagcgccgcctgcccggccgcccatcccggatccaccccggcatcgaccagcagcggatccttgccgccgttctccagcagcgccttcgccccggtccgcgcgcacgccgcggcgatcgaccgcccggtcgccgtcgaccccacgtgcgccaccacgtcgacccgggccgccgccagcaccgcacccaccgcgccgtccccggcgaccatgttcagcacgccggccgggaagtgcagggcgaacagctcgatcagccggtgcccggtccccggcgtccgctcgctcggcttgtgcaccaccgtgttgccggtcaccagcgccgccccgagcagcccgcaggccaccgccaccgggtcgttccacggcgtgatcaccgcgaccaccccgcgcggcccgtacgccatcaggtcgatcgcgtcgtcgttgccggccagcgtccgcccgcggtgcaccgggccgagttcggcgtactgccgcagcgtgccgaccccggccagcaccgagtcgcgggcgtcggcgaccggcttgcccatctccgccctagctagctaggccaccacgtccccctcgtcggaggccacggtccgggtgacgagactgtcgtcggccgggttcgaaacggtcagttcgcggccggagccgcccgggcgccacgcgccgccgatgagctgggtgacctcacgcatacccgagcggatgccccgtggaaatgacggcaaaccagccctgcgagcgaatgtttccgctgttcaggaaggccgacaagtttttttcgagaagtcggtgatcttgggcgtaagtcggcggcgccggggtatccgccgcagcatgcgagtcctgggaatcaacgcgatcttccacgatccggcggctgctctgatcgtggacggtcaggtggtggccgccgccgaggaggagcggttcagccgccgcaagcacggcaagcgcccggtcccgttcgccgcctgggagctgcccgaactctccgccgcgtggtgtctgcaggaggccgggctgacccccggtgacctggacgcggtcgcctactcgttcgaccccgggatcacccgggacgccgccgacctgggcctcgacgacccctgggaccacctgcgcgtcgactatgcccggcgggccccgcagttcctcgccgccgcgctgcccggcctcgacccggaacaggtccgcttcgtgccgcaccacgtcgcgcacgcggcctcggccgggctgtccgtgccggacgacaacgcggtgctggtcctcgacgggcgcggcgaggtcgccgggcacctggccggcgcctaccgcgacggcgagctgagcgtgctgcgcacccaggaactgccgcactcgctcgggctgctctacgaggacctgacccgccacctcggcttcctgcactccagcgacgagtacaaggtgatggcgctcgcgtcgtacggcaagccgaagttcctcgatcttctccgggagctggtccgcagcaccggcgacggcgggttcaccgtcgagcgcatcgactggggcgcgctggccaagccgtgcgcgcccggcgcggaactctcggacgtgcacgccgacctcgccgccagcgtgcagaaacgcctggaagaggtgatcctcgacctggcccggtggacctacgaggcgtccggtggcctgcccactctcaccatggccggcggcaccgcgctcaactgcgtggccaacggccggctggccgccgagggcccgttcgaccgggtctgggtgcagccggcggccggcgactccggcaccgcgctcggcgcggccctcgcggtacacgggcagagcatcccgttcaccaccgccgcgctcggccgcggctggtccgacgaggagctggaagccgacctgaagcgggccgcactgccctacacccggcccgcgtcgatcgccgccgaagccgccgaggtgctcgcccgcaacggcatcgtcgcctggtaccaggggcgcagcgagtacggcccgcgcgcgctcgggcaccgctcgctgctcgcccaccccggcgacaaggacacccagcgccggatgaacgacgtgaagggccgcgagcagttccgcccgatcgccccgatggtccgcgccgaacggttccacgacatcttcgaaggcgtctacccgagcgagcacatgctgttcgtgcaccgggtcaagccggactggcgggatcggatcccggccgtcgtgcacgtcgacggcaccgcccgggtgcagaccgtgcacgccgacaccgagccggtggtcgccgagatgctcgccgagttcgagaagcggaccggcctgccggtggtggtcaacacctcgctgaacaccgccgggcgcccgatggtcgacacgccccgcgaggcgatggaactgttcggatcggcgccggtcgatctgctcgcgatcggcccgttcgcggtccaccgggccggggcgttccgcgcgtgatcaccgtcgtggtgccgaccctcggccgtcccagcctgggcgcgctgctcgccgcgctaccccgcgacctggacatcctggtggtcgacgaccgcccgttcccgcccgatccgctgaccgttccggaccacgtcacggtgatcccggggccggcctgcgggccggccgcggcgcgcaacgccggctggcgggccacccgcgccgagtgggtggtcttcctcgacgacgacgtgctgcctggcccggactgggcggggcggctcgccgacgatctggccgacgcgaaaccggacgtcggcggcgtgcagggccggctgcgggtgccgctgcccgggcaccgccggccgaccgactgggagcgggtcaccgccggcctggccgacgggtcctggctgaccgccgacatggcctaccgccgggcggccctcgaagcggtcgacggcttcgacgagcggctgccgcgcgccttccgcgaggacgcggacctggcctaccgggtgcgcgcggccggctggcggctgacgacgggggagcgcacgacactgcacccggtccgcccggagagcccctgggtcagcctgcgcacccagcggggcaacgccgacgacgccctgctgcgccggatccacggtccggactggcggcggcgcctggagatcccgcccggccgccggtcccggcacgcggggatcaccgggctgctcgccgccgcgctgatcgccggggcggccgcggctagctagctaggggtggccggcaccgccgagttcgccaccgcccggatcgcgcccgggccgcgcgaccggcgggaggtcgcgacgatggtcgtcaccagcgtcgccattccgccggtggcggtcgcccactggctgcgcggctggtggcgctggcgatcagcggcacccaaagcagcggcggcattgacagcagcggcccccgaagcagcggcggcattgacagcagcggcccccgaagcagcggcggcgttgacagcagcggcatccaacgcagcggcggcacccgaggcggcagggcggcacgtaacggccccggaggcagcggcggcggcaccgagaccggcggccgggtgatgtcgcggctctacgacgccgtcctgttcgaccgggacggcacgctgatcgccgacgtcccctacaacggtgacccggaccgggtccggccgatgcccggcgcccgggccgccctcgaccgcctgcgcgccgccggcctgcgcctcggcgtcgtcaccaaccagtccgggctggcccgcggcaacttcacccccgggcagctcgcctccgtccaccaccgggtcgaggagctgctcggcccgttcgacacctggcagatctgcccgcacgacgacaccgccggctgcgactgccgcaaaccgcgaccgggaatgatcgtcgaggccgcgcgggcgctgggcaccaccccgcagcgctgcgtggtggtcggcgacatcgggcgggacatggccgcggccctggccgccggggccgccggcatcctggtgccgaccccggtcacgctgcccgacgaggtcgacgccgccccggccgtggtgcccgacctgaccgcggccgccgagctgatcctgcaccgcgaagccctggtcaccccggcgccgcggccccacccggccggcacggtgctggtggtgcgctccgactcggccggcgacgtgctggtcaccgggccggcgatccgggcggtcgcgcacggcagtgagcgggtggtgctgctctgcgggccccgcggccgggcggcggccgagctgctgcccggcgtcgacgaactgatctcgtggaagctgccgtggatcgacccggaacccgatccggtggcggcggccgatctcggcgggctgaccgagcggatccgggcggccggggtggacgaggcggtggtgttcacctcgtaccaccagtcggcgctgccgctcgcgctgctgctgcgcaccgccggggtgcagcggatcaccgcgatcagcgaggactatccgggctccctgctggacgtgcggcaccgggtaccgcccggggtgccggagccggaacgggcccgcagcgtggccgcggcggccgggttcggactgcccccgggcgacgacggcggcctgcgggtacgcggcgacgacggcttcccggcccgcgccggcggcggcccgcgagtacgtgacggtaagggcccacgactgcgtgacggcgaggacccgcgagtacgtgacggcgaggacccgcgagtacgtgacggcgaggacccgcgactacgtgacggcgaggatccgcgggtgcgggagagcggcggcccgcgggcgggtgtcccgcgacaggtcgcgggtggcgggcacgtggtggtgcaccccggggccagcgtcgaggcgcgctcctgcccgccggacaacctgcggcgcatcgtgcgcgaactcaccgcggccgggcaccgcgtcacggtcaccgcggggccgggcgaggagaacctggcggcgtacgtcgccgatgccgtggcggacctggtggcgccgcccaccctgaccgatctcgcccacctggtggcggccgcctcctgcctggtggtcggcaacaccggcccggcgcatctggccgccgccgtcggcaccccggtgatcagcctgtacgcgccgaccgtcccgtacgcccagtggggtccctaccgggtgccggcggtccggctcggccgggccggcgccgcctgccgtgacacccgggccacccgctgcccggtgcccggccatccctgcctgtccaccgtcgaaccggcccaggtgctcgacgccgtcgagcggctcggcgccgccagccttgaggacgtcgcgtgaacatcctgctctggcacgtgcacggctcctggaccacgtcgttcgtccagggcaagcatcgctacctgatcccggtcaacgacgcccgcgacgcgtggggccgcggccgggcccgcaccttcgactggccggacagcgtcgaggagctgccgctggaccagatccgcgacgcggacgtggcgatcgtccagcggcccgaggagatcgacctggtgccacccagcctgccggtgatctacgtggagcacaacaccccgaagggcgacgtgccgaacacccggcacccgatggccgaccgggacgacctgatcatcgcccacgtcacccacttcaacgacctgttctgggactgcggcggcacccggaccacggtgatcgagcacggcatcgtggagccgaaggcccgctggaccggcgagctcgaccgtctcgcgatcgtcaccaacgagccggtacgccgcggccgggtgaccggaaccgacctgttcgagcggttcaccgcggcggccccgatcgacgtgttcgggatgggcgtcgccgatctgcccggcgaccggatcaccccgcacgaggacccgccgcagcacgccatgcacgacctgctcgcccagcgccgtgcctacctgcatctgtgccgatggacctcgctcggcctcagcctgatcgaggccatgcagatcggcatgccggtgatcgcgctggccaccaccgaggcgatcgccgccgtgccggacggcgccggagtgctctccacccgggtcgacacgctcgtcgaggccgcccactggctcatcgaggaacccgacgaggcccgccggatgggcgaacgggcgcgccgcgcggcgctcgcccggtacgggctggaccgcttcctcgccgactgggaccaccttctggagggacacacatgcggatcgcgatgatctcggaacacgccagcccgctcgcggcgctcggcggggtggacgccggcgggcagaacacgcacgtggccgacctggcctcggcgctggtcgcggacggccacgaggtgcgcgtgtacacccggcgcgacagccccgacctgcccgcgacggtgccggtcgaggccggcttcgaggtggtgcacgtcccggccgggccggagcggacgctgcccaaggacgacctgctgccgttcatgggcgacttcgccacctggatggcgcgggactggctggcctggccgccggacgtcgcgcacgcgcacttctggatgagcggcctggccgcggtcaccgcggcccgccgctgcgacgtgccggtggtgcagaccttccacgccctcggctcggtgaaacgccgccaccaggggaccgacgacaccagcccggcgcaccgcgtcgcctacgagcggcagctcggccgggtcgtcgaccgggtgatcgtgcagtgtcaggacgagctcgacgaactgctgctgctcggggtgccccgggcccgcaccacgctggtgccctccggggtcaacgtcgaacggttccgcaaggacgggccggtcgccccgcgcgacagccggccgcggatcctgtcggtcggccggctcgtcccccgcaagggtttcgaggacctgatccgggcgctgcccgaggtgcccggcgcggagttggtgatcgccggtgggccgccggccgcggcgctcggccaggacccgtacgcccagcggctgctgcacctggccaaggagtgccacgtcgaggaccgggtggagctgctcggcgcggtgccggccgcccggatgccggcctggtaccgctcggccgacgtggtcgcggccaccccctggtacgagccgttcggcctgactccgctcgaagccatggcctgcggtgtcccggtagtcgcgaccgccgtcggcggcctcaccgacaccgtcgtcgacggggtcaccggcgacctggtgcccgcccacgacccgcacgggctcgggctggcgctgcgccggctggtcaccgaccagagccggcggctcagctacgcggccgccgcggtcgaccgggccgtgcacgcctacgcctggccgcacatcgccgcccggatgagcgcggtctacgcccgggtcgcctcgctgtcggcggcggtcgcctgatggaccccctggacaagcacctcgccgccctggccgcgtcgctcgccccgttccggaccgtcggggcccgcctcgccgactggggtgccgacctggccgcacacctcggcggcggcggccggctgctggtcgccggcaacggcggcagcgccgccgaggcacagcacctggccgccgagctggtcggcaaactccgcgaggaccgcatgccgctgtccgcgatcgcgctcaccccggactcctcggcggtcaccgcgatcggcaacgactacggcttcgacgaggtcttcgcccggcaggtgcgggcccacgggcggcccggtgacgtgctgctggtgctctccaccagcggccgcagccccaacctggtcgccgcggtgcgggccgcccgggactgcgggatgcgcacctgggcgatggtcggcgccgggtccagcccggtcggcgacgcctgcgacgaggtgctgcactgcccgtcccccgactcacaggtggtccaggaactgcacctggtcgcggtgcacatcatgtgcgaacacatcgacctcaatctttcgcagccgacggctggaggcacccgcgtgaagaagccactgctggtcgtggtcggggacaccctgctggaccgggacgtcgagggcacggtgcgccggatcgcgccggacgccccggcgccggtcctcgacgaaacggaggtcagcgagcgtccgggcggcgctggcttggccgcgctgctcgcggccggccgcgaggactacgacgtcgcgctggtcaccgccctggcgggcgacgccgccggcgcacggttgagcgagcttctcaccgccgccgggattgcggtgtacgccttgccgctgcccgggtcgaccccgcagaagatccggatgcgcgccgcgggtcaggtgctgctgcgcctggaccggggcggggacgcgcggatgcccggtgaggcgccggacgggcttctcgacgtgctgaacgaggcatccgcgatcctggtcagcgactacgggcgcggggtggccgggcacccggcggtgcgggccgcgctggcggcggcgagcgcgccgatcgtctgggatccgcaccccaacggcgccaccccggtgccgggagtcgcgctggccaccccgaacctggccgaagcgaaagggttctccggcgacgccgggaagggcaccatgctgaccaccgcgcagcggaccgggcaccacctcctcgaccactggcgggcccgggccgtggcggtgacctgcggggccggcggggcggtgctcagccaggccggcccgaccccgctggtcatcccctagctagctagttcgcggcggccgccgctctcgcgctggccggcggggcactggtctccgaggcggtgcaggacgcggtggcggcggccaccacctatgtgctgaacggtggggtgaccgcggccctgtccccggccgccgccaccccggccgttcccgccccggaacgcatcggcgccgacgcggccgggcggctcgccgccgaggtccgcgaccggggcggggtcgtggtcgccaccggcggctgcttcgacctgctgcacaccgggcacctggccaccctgcgcgccgcccgcgggctcggcgactgcctgatcgtctgcctcaacagcgacgagtcggtgcgcgggctgaaaggaccggaccggccgatcaacgcgcaggccgaccgggcccggctgctcgccgccctggactgcgtggacgccgtggtcatcttcgacgagccgacgcccgaggcggtgctcagctggctgcggcccgacgtctgggtcaagggcggcgactacgccagcctgcccgaagcggacctggtcaaacgctgggacggccagaccgtgatcgtgccctacctcgacgggcgctcgaccacccggaccatcgacgcggcccggtccctgaccgcggccgccgacagcaggaggtaacagcagcatggacgcagtgatcgtgaccggcggatcgagcgggctcggcgccgccgtcgtcgacgccgtgatcaaggccggcggacagccggtggtgatcgaccggcaggcgcccgcccgggagggcgtcccgtggatcgagtgcgatctcgccgacacgcgggccgcggaacgggcgacccgggaggcgatcgccgccgtcgacgcgacggtcagcggggtggtcaccgccgccggcttcgacgtgccgggaacgctgctcgacgtgccgggggagacctgggaccggatcgtggcggtggacctgctggccaccgcggcggtggtccgcgcggcgctgcccgcgctcaaggaatcccacgggaccgtcgtgacggtggcgtcgaccctggggatcaaggcggtgtcggacgccacggcgtactgcgcggcgaagttcggggtggtgggattcacccgggcgctcgcggcggaactggccggcgaggtcggggtgaccctggtgatccccggcgggatgcggaccagattcttcgacgagcgtgacgacaggtacaagcccgggccggacgcgctgctcaacgatccgtgcaacgtggcggacgcgatcctgttcgcgctgcagcagccggccggatgcgcggtgcgggaactggtgatcgcggcggagacggagacgtcctacccgtgatcctggtgttgcgcgccctcggagtgggcgacctggcgaccggggtgcccgcgctgcgggcgctccggtccgccttcccggggcgggaactcgtgctggcggcgccgaggtggttgacgccgctggtggacctgatcggcggagtggaccgggtgctgccggtcgacggactcgacggggtgggcgcacccggtctcccggaggcggtttccggggcggagctcgcggtgaacctgcacggcagcgggccggagtcgcatcggatgctgcgcggagccgggcggttgtgggggttccggtgtgccgcggcggagcatctcgacgggccggagtgggtgcgggacgagcatgaggtgcatcgctggtgccggatgctgcggtactacggcgtcgccgcggacgaatcggatttgtcgctgatgaagccgttggtggggtcggcttcggtcaccgtggtgcacccgggggccaagtcggcgtcccggcggtggccgcccgagcggtacgcggcggtggcgcgcgagctggccgggcggggacaccgcgtggtgatcaccgggagcggggcggaacgggacctgaccgcgaaagtggcggcggacgcgggcctcgggccggaggcgctgccggacaccgacatcgggtcgctggccgcgctgatcgccggcgcccggctgctgatcagcggggacaccggggtgtcgcacctggccaccgggttcgggacgccgtcggtgacattgttcgggccgatgtcgccggcctactgggggccgccgccgggacgggcgcggcaccgggtgatctggcacggcacgagcagcgagcgcggcgaccggcccggcccggacgtgcacccggcgctgctcgccgtcaccgtcgacgaagccctggccgcggcggaccacgcgctcgcggcaccgtgacgctccatcgaggagcgacgatcagttgtcggccgcggcgcccgacgggacgaatgtgatcttggtgttcgccgccttggatccttccccgggtgccctttttcgccgtaaccgccggatgtccgcgcggacgcctggttaacgtagcggcatgccccctgacggttgcgcccggtggcgtgggcacatcatcgtgtgcgggctggacgacgtcgggctgcggaccgtggagcagctctatcacgccggcgtccgggtcgtcgtggtggaggacatcgcggatccgcggctggtccgggtggtgcgtggctggggcgttccggtcgtggtcggcagcccgcggctgcaggagacgctggacgaggccgggctgcccggcgcggtcgcggtgatctgtgtgctcgccgacgacctgcacaccctggaggccgcgctgttgatgcgcgagctgcgcccggacgtgcgggtggtggtgcagctgcggaatccggcggtcgggcgggcgctgtcggcgatgcaggtcagcgtgctggacgtggccgggctgtcggcgccgtcgatggtcgaggcctgcctgcgcagcgggacgcacgagctggatctggacgggcagccgttcgtggcggcgcaggtggtcgccgagcagtccgggacattgcggacgcggtacgggtcgttggcgccgctcgcggtgatgccggcggcggccgcctcggacgacgacgtggtgatctgtcccggtcgggaccatccggtgcggcccggggacctggtgaccctgctgggcacgccggaggaactggcggcggcgcggctgctggacaaggcgcgcggtccggcgcacgccggacccggacggtgggcgcggtcgctgcacctggccgggtccgtgctgcgggcgctggacaggcggatagcgtacgcgtcgatcgccctgatgctgctgctcaacctctccatcgtggtgctgcaactgggctaccgggagccggacggcacccggatgacgctgctcgacgcggtctacttctcggtcgagtcgatcgccaccgtcggctacggcgactacaacttccgccaccagcaaccctggctgcgctgcttcgcgatcggcctgatgatcctcggcgcgtgcttcgccgcgacgttcatcgcgctgctcaccaacgtgctggtctccatcaagatccaggaagcgctcgggaaccggctgctcgaccggctcaccgaccacgtcgtggtgatcgggatcggctcggtcggcacccgggtcgtcgagggcctgcgggccagcggcacccgggtggtggtgatcgagtcggacgaggacaaccggtacatcgaccaggtccgcgacagcggcgtgccggtgctgatcggcgacgccacgctgccccgcaccctggaccgggtgcagctcgggtcggcccgcgcggtcgccgtgctgaccagcgacgacctggtcaacctggagaccgggctggcggtccgggaccggctcggcgagcgctggggatcggtgccggtggtgctgcggctcttcgaccggacgctggccgcgaccgtcgagcacaccttcgggctgggtctggcccgctccacggcggccctggccgcgccgtggttcgtcggggcggcgctggggctggacgtgctcgccacgttctacgtcgggtcgcagctcatgctggtcgggcggctcaccgtggccgccggcggcgggctcgacgggctggccatgcaggacctgtcggcgcgcacccgggtggtggcgatccgccgggccagcgggcacggcgagctggaacacccgccgcggcgcgacacccggttcgcggccggcgaccaggcgcacctgatcgggccgtacgaggagctgctccaggtgctgcgccgggacgcgctgtcgacctcggaactcacgccgtcggaaaatgtcgtacccggtcgttaggttgtgggcctcgtcgttggtggggagggtcccgatgtaccggcagggtgatgtgctgatcgttccggttccgccggccggggtgccggcgtgcgcgccggtgccccgggacccgcgcgggcggatggtgctggcgcgcggtgaggccaccgggcacgcccacgtggtcggcgggcccggggtgcggctggtcgccgacctcgacgacccggagcggatgttcgtcgaggtgccggcgcacgggcgggtgtcccacgaggagcacgggccgatcgcgctgccctccggggtctaccgggtgatccggcagcgggaatatgttccgggcgcgttccgtccggtcgcggactgagacgggggagcggatcgtgcgactcacgcatgagcaggaggcgctggcggccgccgtcgaggaccggtggctggccgccgcggtggcgctagctagctaggccgtgggcggcggcgcgcaaggccgccctggcggcgttcggggcgcagggctgggcgcagctgagcggggcggccgggcggcggtcgtgggcgctcgtgatggacatggtggccgggcggctgcggcagcggctcggcgaggatgtggccgccctcgggcgggagttccagcggccggtgctcgacgcgatctacgggcagcacgacggcgcgtggctgagcaccttcgacgcgggggaccggctgctgcccggggccgggctgatgggcgggctggccgggctcgcgcaggtcgcggggaacgccggctggtggtgggcgcacgagcgggtcgccgtgctcaccgagcgtccggtggcgctgacccgcgacaacgtggggcggctgcaccggggcgacgggcccgccctggagttcgccgacggctacggattgtgggcctggcgcggtatgccgatcccggccgggctcgccgctgagctgccccggctcagcgtggaccggatccggggcgagtccaatgccgagatccggcgggtgatgctggaacacttcggctacgagcggtatctgcgggaggccggcgcccgtaagcgggatgcggacgagaccggggtgctgtggtggctggacctgccgggggacgagccgctggcgatggtcgaggtggtcaacgcgacgcccgagccggacgggagcagccgggtgtactggttgcgggtgccgccgcagacccggaccgctcgggagggggtggcctggacgttcgggctgaccgcggacgaatatcagccgttgatccagacctgaccgcggtcccgcggtttcgggccggtccgttgctgtcccgcggtcttgcgctgtctcgcggttttgcgctgtctcgcggttttgcgctgtcccgcggccttgcgcgggccggcagccggggtggatcgtcagggggtggggagccagccgttctggagggcggcgatctgggcttcgtaggtgtcgaggccgtcgtcggacaggatgccgggcagcagatcgccgaaggcgttcacctcggcgacggcgtgcgagcgccagttcgcgtggaacatcaggtccacgccggcgtgcagcgtgccggggaaacaggcggcggcccgctcgcaggtccgcatcgccgcggcccacgccgcgccgccggccgccgcgcggacggcggcgacgtcaccgcgggcgttgcccaggtggagattcgtcatcggggaacggctcgtgcgggcgacgacgtgccgcgcccgaccggcgatcacgaccacccgcagatccaggactctgccggcgagggccgccttggggaaccagcgttcgacgtgcaggccgtccggtgccagccggtcgatgatcgcggcgatcgaggcctcgtcgtcgtaacggcgtacccgcaggttgttgaagatctttccgtcggccagctccaccgaggtgaccgccatgatcgggcggtggccgcccggtcgccggccgccgagcgcgagggccaggacgccggacgccgacgagccgtaggccgccttgacgaagacccggctccatcccgccgtgtccagcgcggatcgcagcgcggcatacccggtgaccgcgatctccagcgcgggcggcacggggactccggcggcggacaggacggcgtggcagcggggcttggcggtcatcgtcagaatgtccgccggccggttcagcaggatgccgccaccggcctcgatccggtgcagggccactgccaacccggcgaaggccgccgccccaccgacgatctcgccgtgctccgctgtcggtccggcggagacagcggcctggtcgtgctccgctgtcggtccggcggagacagcggcctcgccgtgctccgctgtcggtccggcggagacagtggcctcgccgtgctccgctgtcggcccggcgaaggtcgccgccccgtcgtgctccaagggcgggtccgggcggtgtccgccgtcccggcccgagtggtggcgcggccggtgtccggggtccagcggcggcggtgcggtggtgcccagggcgcggagcagggcgtcgacctcggcgttctcgcccggcgaatcgatccgggtcagggtgtcggggccggggacccggccggtgagcaggacctcgcgccacgggaagatctccggcgtgggcaggccggcgcggtcggcggccgtgacgaatcggccgacccggcggttctccgggttgccgacgacggcgaggcggctcactcggcggccgtgacgaatcgggcgacccggcggttctccgggttgccgacgacggcgaagcggctcactcggcgcagaccgtgtagcggccccagcgctcctcctcctggcgctcggacacgtcgacggtgacgccgggcagctcgtcggcgacccgctgcgcggtctccggcgacatgaagtggtggtgcaggtcgagggtggtcaggtgggtcagcggctgcccggtcagcagcgactcggcgccggtgtcgccgagggtgcccagggacaggtcgagccgggtcaggcgggccaccaccggcgccgcggcgaccgcggcggccaactcgtcggcgatctcggcgttgcacaggcccaggtgggtgagcgcgggcagggagcgaccggccaggatcggcgcgaggtcctcggcgcgggcgtcgccgccgtagttcgccacgcccagccacagttcgaggtgggtgagggcgggcagctcgcacgcgccgaccgtgcggatgaccggggcgggcaggccgccggactggatcaccagctcgcgcagcgccggataccggccgggttcgaggccgagaccctccgagccgcgcacccacagcacctccagcgccgggaacgcctccagcagcggtgtcacgtcgccctggttgatccaggagatctcgcactgctcgtaggtcatctcgccgaggaacagcgcccgcagccggctgagccgggccacgcggccgatcagcagctcggccgggaacgcggtgtcgaaggcggacccccagttgccgacgaccagagcggtgggaccgcccggcccggcccgctccagcacccggtcgagggcggcctcgaactcggacagctcggcctcgtagtcctccaggtcgatccgccacgccacggccgccgggtcgacggggccctgctcgtccgccacatcgacgatcggcagacccgcgaaggtggtcaggtgttcgttgatggtcacgggactccctcgtccgtcgtaccggatcagtgccggaaagctaccaacccccgccgacactgtctgatcagggactcgtccctcgaccagcgagttgatcactgtcagtatgtgcgagccgacttcccgtgatgacgaggagggctcgtgatcaccatcctgctggtgcggcacgcggacatcgacctgccgccggtctcggccgatccaccgttgaacgaggcgggccgccgccgcgccgaggccctggcgcacctgctcggcgcggccggcgtcagcacggtgttcacgtcggcgttccggcgtacgcgggagaccgtcgaaccgctcaaaatggcgtcgcgggagatgccgagcgcggctaccgtggctcatgaggcgcgcgccggcagatacggcgccgtcgtgttgatcgccggccacagcaacacggtgcccgaggtgattgccgccctcggcgccccgcccccggccatcggcgagaccgatttcgacaacctcttcgtggtgacgaccgcggacgatgccgagcccggcctgctgaggctgaaatacgggatttccctctcctgagttgtatctggcgccgcccggctcgcatctgttccaccagaagcgccacgatcggattcgaggttgaccatgacgtacgcccaccggatcagctgcatcaccccacccttcattctgaccaggctcctggacagcgacaacgtcgacatccgccaggcggccctgtccactctggtgtcgaccgcgcacctgcgcggcgagcgcagcgtccgcggcctgatcgccggcgcgctggcctcgccgtcggacggccggcgcagtgtctacgactgccggcacagcacgttcctgccgttcgccacgctggtccgctcggaggacgacgccgccgtctcggacgcctcggcgaaccgggccttcgacggtttcggcgcgacccgctcgttctacgccgaggtgttccagcgcaactctatcgacgaccgcggcatgcggctcgagggatacgtgcaccggggtcgccggtacaacaacgcgttctgggacggccaggagatggtcttcggcgacggggacggccaggtcttcaccgacttcaccgggtcgctggacgtgatcgcccacgagctcacgcacggggtcaccgagcacaccgcgggcctggagtaccacggccagtccggcgcgctgaacgagtcgatctccgatgcgttcggttcgatggtcaagcagtggtcgctgggccagaccgcggaccaggcggactggctgatcggcccggaggtgttcaccccgcacatcgacgccgacgcgctgcgctcgatgaaggcgcccggcaccgcgttcgacaacaagctgttcggcaaggacccgcagcccgaccacatgtcgcgctacgtcgacgcgccggacaccgacgagggtgactggggtggtgtgcacaccaactcgggcatcccgaacaaggcgttctacctggtcgccatcgggatcggggggaagagctgggaggccccggggcacatctggtacgagtcgctcaaggcgtcgacgtccaaggcccagttccaggacttcgccgacaccacgtatcgcaaggcggagcagctctacggaacggacagcagggagcagcaggccgtcaaggcggcctgggacggggtgggtatccaggtgaccacgacaccgacgctcgcgcgctagatgcgggtgtccctggcgtcgcacggcgggatggcggccgcgatcacctcgcggctgccaccccgggtgctggacgccgatcgcctgccgcgggacgcggcccaggagctgcgccgcctggtcgcggccgccaccgcggatccgggtggcgcagctccgtccccgcgcgcccgcgacgccatgacgtacacggtcacgatcgacgacggcccgcgttcgaccacgctgaccgcctccgacacgacgatgtcagcggccttcggcgagctggtcgcgtggctcgaccagcggatcggttgacgcggcccggtcggtgagctgtccggcgtacgcgccgtgcacgtcagcggtcccggcgtcgcggccccgtgcctcgtcgtgcacggccgagaccgggacgcgattctcgccgacggtcggctcggctttggggcgaccgtgccggctgtcccacacgtcgcgcaggatgatctgcacgatgccggcgaccgggatggccagcagtgcgccgaggatgccggccagctcgaccgcgatcaggatcgcgacgagcacggtgagcgggttgagctgcaccgtccgggcgaagatcagcggttgcagcaggtggttctccaactgctggtagaggacgaagaagacgatcaccacgattccggcggtggtcgactggacgaatgccgcgatggtggcggccacggcgccgagcgtggcgccgaccagcggcacgaggtcggcgataccgacgaacagagcgatcaatccggcgtacgggacgtgcaggaccgtgaggacggcgaaggtcagcgcgccgcagatcgcgctgatcagcaggttgccggtgatgtacccggtgatcgtcttggcgcagtcgtggccgacccggcggatccgttcggcccggcgcggcgcgaacagggccaggaacccgtccacgatcttcggggcctccagcaccatcaggtaggacagcacgaagatggtcacggtgccggcgatgccggtggcgaccgagcgcaggaacgccagggtcggggcgcccagcccgctggcgtactcgcggaaccgcccggcgttggcccgggcgtactcgaccacgtggaagcgttcgagcagcggtccggccgggccccggccgtgccgggcgtcgtcgagcaggccgggcaggttcgccatgacctggctgccctcccgggccagcggcgccacgaacaccgtgaccagaccggccagcagcgccagcgccgcgacgaagaccagcagggtcgcgagccaacgcctgcagaatgtcacccggcgggtcatccagttcaccgccggatgcagtgccaccgcgaagaaggccgcgatcaggatccaggtcaggacccggcgcacctcatgggccagatacagcaccgccagcgtggacagcgtcacgcccagcacgaccagcgtgcggcgtgccagcacgccatagcccgtttcttccatgacggacagctacccgccgttgaccactgcaaacaagtagcggtggtcattgcgcggcggcgtacccggcgatcaggatgtcgaccgcctcggtgaagcgggagtcgaagtccagcccggcccgggtccggatcacctccaccaggttcgggaactcggccgggtccagttcgtccgagcgctggtccaggtcgggtccggcgccctcgtgccccggcgtctgcccgacctcggccagggtgtgcccgatggtgaacgtggccagcacgttcaccatgtccatcgcccggcccagcggcaccccggccgcccgcatcgccgccagccacgactccgaccagcgcagcgcgtcgggcgagttgaccgggcgggtggcggccagcggcagcacgccggggtgggcgatcagggtcttccgcagggcgtgcgcgaactcccgcagccagtccggccagtcgccggaggtgggttcgccgaggctgccgaacgcggtctccagcacccggtcgaccaggccgtcgagcagggcgtccttgttcggcacgtgccggtacagcgacatcgcctcgaccccgagccgggcgccgagtttgcgcatggacagcgccggcagcccgtgcgcgtcgatgtagtcgagcgcggcgtccagcaccttggccctgctcaggccggctttctcgcccgatcggcggtctggcatcgaaactcctcttgacgacgcttacggcgtaagccatgctaccggagacggcgatgcttacgccgtaaacatctttgggaggtggcgatgaccgccctggcgttgaccctgatcctgctcgccgtcggctatcacgcggtgatgacgctggtcgatctgttcccgttcaacaacgtccgcgacgcgaaacgcgccgagcgggtccgggaggtcgcgacgaacgcaccggtgatggcgctgcccgcggtgctgctcgccctcggctcggcatccggcctgccgatcctcggctgtctcggcggcgtcgtcgagctgctcgcggtgctcggcgggctgctgctgtggtggtcgccctacctggccggggtgaccatgccgtgggccaccgccggcaccggcgtcagctgggccgacctgcacgcccgcacctacgcccgcaccatcatggtgctgccccggatcggtgggcggccccgccccaatctggagcacatcctgctgcactcgctgatgttgagcgccgcgatcaccaccctggcggcggcttcgggccggcacgggtgagctgacggcgtacgccgcaatcgtcggtcatgaatgttcgcggaccgggaccggtgccgcgacccggcgccgcggcaccggaatgcgcacggtgagcggattccggtgccgctccgacgtgctgaccgtaagcgaccagtcgacccgccagaccggccagagcaccgccgcgagatagccggtgccgcagatccacagcgcggtgcgcaggccgccggtgctcagcagcaccgcgccgaacaggccgccgaccgggatgccggcccacgcccacgcgttgatcagcgtctgcacccgcccgcgcagcgccgccgggatcagctccacctgcagcgtctccagcagcggattgaacaggcccgagccgatcccggccagtgcatagacggcgatgaccgcctccggcggcaggcccagcgcgaggacgacgatgcgggtcggcccgctggtcaacaccccgatcaggtacgtcgcccgccgcggcagccgcgcgccgaaaccggccgacgcgagcgccgaggcgatcgacgcgagccccaccgtgctcagcgccagcccgaccaccgtcgcgtcgtgcccgccggcccgcgcccacaccggcagcagcaccgccatcagcgcctgatccagcagattggtcaccacgaacatcgcggtcaccgcgcgcagcggcgcactcccgcgcaggaacgcggtgccggtgcgcagccgatccagataggtctcgtcgtcccggccgcggtcacgcaccggatcggtcaccgtcagcgtcacgatgagcgtggccacgcccagcatcgcggccgccgcgaacagcgcccggtccccgccgatcgtggcgaccagccaaccggccagcgcggtcccgaccgcggtggcggtgcgctcgaccgcggtggccagacccacgccgcgcaccgtcgactggccggcatccgccgcggcgaacggcaccagcagccgcttcgcggcgctcgccggcccgtccgcgcaccccaccagcagcagcatcacggtgagcagccagatcggcggagcgccggacagggccgggacgatcagcacgccggccgagacgacgtccccggccgcgctgatccgccgcgggtcgatccggtccagcagcggcccggccagccactgggtgaacgcgtacggcaacacctgacaggccaccaccaggccggtctgcgcggcgctgccggtgcgctccagcaccagccacggcaccgcgacggtgagcagccggttcgccgacagcgtgcaggcctgcgaactcagcacaccggtcaatccacgccatctcacccgggcatcaccgggccggccacacggttgaacaagggcgccatcgacatccttcggcaaaaggcgggggcggtattcctcgcaccgtagatgccgacggccacggcaggtagtcgcgcgtcgatgacacgatagccggtatcagcggtccgggtgcggtcgccggtgccggccggcgaccgcttaccgcaggtcaggaccggaaaggtcaactactcagggtcgcgctttccggatactgcccggtccgaaatgatgttcccgaagtcgcacagtgagtccgtcgtacgatttctgcttgcccttcgcggcccggtcgaaccggctccggccgccttttctcaggcgggctcgggttccggctgggtggccggctcgggccgggccgggaccggcgagatcggcggcatcggttccgcgggcgccggcggcaggtccggattggtcggatccagttcgcccggatcgtcgggaatcggtgcgcccgggtccagcggcgggtagcggtccggatcggactgctgatggtggatcggcatcgggtccctccctcgctcggggcctgtcaagatccgcttacccgacgcgtgacgaggtcaaacgaggtcgtcctcgctcagggcgtcggcgatcggggtggcgccggcgttgaaccggacgatccggtggatggtcgccggctcacccagggcgtgcgcgacgaccgcggccacatcggcgcggctgaccgacccggccgtcgcaccctggctggccgtctcgatccggccggtcgccgcgtcgtcggtcagccggctcggggccaggatcgtccagtccagatcactcgacgcgaggtgcgcgtccgccgccgccttcgcctccgcatacgggaagaaaccgctgtcggagggcacgccgtggtcgatccgcgcaccgaagtacgacaccatcagatagcggcgtacgccgatgtgcagcgccgcgtccatcgaccggatcgccgcgtcccggtcgaccgcgtacgtgcgccccggatcgccgccgccggcaccggccgaccagaccaccgcgtcgtgcccggcgatcagctcggcgaacccgtcggcgtccagcgtctccacgtcggcgaccaccggccgggcaccggtcgcggccacgtcgccctcgtgcccgggatcccggaacgccgcggtcacctcgtgcccggccccgaccagcagcggcagcagcagccgcgccaccttcccgtgcccaccgacgacaagaacgcgtgcattgtccattccggtcacgctacccggattgtgcgcgggtggcggcggcgtacccgaacggtacgcccgggccgctccgggcccgggcgcaccacccgtcacttgaccagcggcttcaaggcctcaccgacggcggtcacgacaccgggtcggtggccgttcttgatgaggttgatggtgatcccgccgatccccgcgccgagcaccttctcgtgcagctgctcggcgacctgctcggcggtgcccaggaacgcccggttccggcggtcctccgggaccagcgcgctgaactccttgacctcctgctcgttctccccgaccaggcccatggccaggtagctggtggccagcgtggccgggtcccgcccgatctcctcgcaccgctcccgcagcacggacaccttgcggcccacgtcgtcgacatcgcagatgatgttcatgtggtcggcgaaccgggccgccagccggaacgtcttctgctcaccggagccgcccagcatgatcgggatgtgcggccggacccgcgggttgttcatcgccccgcgcgccacataccatttgccctcaaaagtcgccggctcacccttgagcatcggggcgatgatggtcagcgcctcctccagccgctcgaaacgctgggtgaaggtgccgaactcgaagcccagatcgtgatgctcccgctcgaaccagccggcgccgatcccgaggatggcccgccccttcgacaccacgtccagggtggtgaccgttttcgccagcagggtgggattacggtacgtgttcccggtgaccagcgtggacagctgcaccgtcgacgtcgccgtggcgagcgcgcccagcgtcgtgtaggcctcgagcatgttcgcctcgggcgcgccgatacccggcagctggtagaagtggtccatcaccagaacggtgtcgaacccgaccgcctcagcctccctggcctgcgccacgaccgtgtcgaacaggttctcgtcggggactccggggtaggtgaaattcggaatctgataaccgagccggatgctcacgatgcctccacgacttgataatgtaagagctaacttacacccgccccggcgccatctccgcccggttcggcgtactgtccctctctccgtcgcctcccgttcgcgcagccgcctcccggccggtggtggtccggtccgccgttcgcgggtgtcgtaggggagggtggttcggcggggcgggtccgaccggctggccggttcggtcgaccgggatttccaggagaggcggtgtcgcggtgtcacgggagcgggcctaccaccacggtgacctgcgggctgccctgatcaccgccagcttcgaacagctcgccgaggccggtctgcgccggttctcggtcgccgcggtcgcccggcggctcggcgtcagctccgccgcgccgtaccgtcatttccccgaccgtgaccacctgctctccgcggtctccgcggccgccgcccacgacctgcggtccgcgatcctcacggccgccgacgaagccggcgccgacccgtccgcccggttggccgcggtcgcgggggcctatttccggtacgtggtccgcaccggcgccggtttccacgtcatctacgcccccgagctgtacgcgatcccggacaccccccgccgcgaccacacccgcgccctgatggacacgctgatcgacctggccgccgccaccgacgtccccacctaccagcaggcggtgagcctggtggaagcggtcatcgcggtcgcccacggctacacgtcgctgtacgccgacggattcttcacccgaggcgcccgctccgtcgacaccaccgccacccgggccaccgacgccgcccgcgccctgatccacgcctgatcgccaccgccgctccgggcgccccgggtcaggcggatggggcgcgcgggttcggagagtcggtagcccgacggtcggcccatcgccggtcatgatcgttcgcgatctccgcctcggggttcaggcgtccctcggccagcagggcggtcaacagttcgaggtccttctgcctctcgccggtcctgccgagcgccacatcgcgggcagcgaacacgtcgatcgcccgccgggcgaacgacgcgacgtcgaccggcggccggtaggccgcagcccacagttccctgtccaccgtgaccgctgcctactcccaggacgccatcggctcggcctcgccggccctcgcccggccgagagccgacatccgtgccaggtacgccaacgtggagagcggcgagaaaggccagctctccaccggaaaagcgcgcggtagcgtccggccgatcccggccacgccgagggcacccacgagagcgaagacggcatcgtcggccagctgatccccggtcaccaccgtgcgcaccgccgccgggtcggcgggcaggccggccgccgcgctccaggccagcagcccgctcaccacgtcccccaccgggcgaccggtcgcaccgggcggcgtccgggccccgtcctcgtcaccgcatgccgccaggacgtcgtaccgacacgtcaccagcccggtggtgtgcccgacagcggtacacagcagcgcccgatcactgtcgaacacctgggcggccagcaccggccgccccgtcgacatcgccagtcgacggcacggttcccgaagctccagcgtctcgaggtggccgccggtctccaccaactgccacccatcgccgagcggccgtacataacgatgctggtacccgaagtcgtccatgccctcctcgtgaaccaacagccgcgccgaacgacccaccacgatgacgcccgtgtatcccacgcgcacagcctaggcagtcccctgctcgggtcgtgtcggcgcccgggtcgtgtcccgacccggtgactgtcttgatcggattcctgacaggaggggtgccggatcgtcccgcgttcggaatcgtccaatgcctatcccaccgaaccgaagcaggagacgttccgacgatggcttccccgctgtccgactcatcgcagatccagggcaacatcctgcggccgttccgcggcgaccaccaggcctttgtcttcctgtccttccgcagcgaccggcccggcgcgcgggcctggctgaccggtgcggccggccgcaccaccggcaacgacgaagttccgcagagccgacccgcgccggacggcaccccggcgcgggccctgctgaacgtgggcctcaccggcaccgggctcaccctgctgcacccggagaccgccggcgacctggccggtcacaccgccttctggcaggggccgctcggcacccgcctcgacgacgccggtctgctcaccaccgcgccggccctgctcggcgacctcggccccggcgacccctcgcagtgggtggtcggcggaccgggccggccggtcgacgcactgctgaccgtcgccgccgacgagtacgacgacctcgccgtcgccgtcgagcgggaactcctcgaggcggaacggcacgcgctggccatcctgtccgtgcagtggggcggtgtgctccgcaacgagcacggcaagcgcatcgagcacttcggtttcgccgacggcatctcccagcccggcgtccgcggcttcgccgacacccagaagtccggcgcgccggtcatcgccgccggcgagttcctcctcggccaccccggcgaacgtcgcccgccgtcctggacgccgcggccgaccccggcagcgtggatgcggaacgggtccttccaggtgttccgccgcctgcggcaggacgtggccggctggtgggagcacatgaacgcgctcagcgccgccgacggcggatccccggaggacgccgccgcacgggcgctcggccggcacctcgacggccggccgctcgccgcgcccgaccgggtcaacgacttcacctaccacggtgacgacgacggcgcccggacaccgcgctacgcgcacatccgcaaggtcaacccgcgcgaggacgccgtcttccgcgaccgtggccacaagatgctgcgccgcggcatcccgttcggcccgcggctgcaccgccaccagccggacaacggtgaggagcgcggcatgctcttcaacgcgtacatggccagcatcgacgaccagttcgagtacgtgcagcgccggtgggccaccgaccccggcttcccgtcctcgaccctggcccgctacggccgcgcgggcgccaccgacggcccggccgtcgacggtctcgacccggtcctcggcggcaacgcccggcaggccggcgagaccctcgccccggaggtggtccgcggcatcccggccgccgccttcggcggcttcgtcaccaccagcggcgcggtgtacgccttcaccccgtccctgcgcgccctgcgccagctggccggcgacgccccactggacgccctggccaccgcctgaccaccggcctagctagctagggccggggctcgcgggctgagcggtcgatgcgttgcagcagctcatccaggtcggcgccgtcctcggcggcgatccagcccggcagttccggcagcggcgggccgggcggcagcagcacgccggtgagccggcggtaggcgcgccggtattcgacgctcggcgcccgctcgtacaaggtgcggtagatgtcggcggccgtcgtccgggcctgttcgtcatgcggatcgagctgacgcaccgcgtcgagcagcgcggccacctcgtgcggctcgttccactcgtcggtcgccttccgcagcatgtcggtggcatccccggactccaggcggccggcccgcacccgcagccggatcgacaggatgtaggcactcacccgggcgtcccgctcgtcgtgctcctcggcgatccgcagcgcctcggcattgagctgctccgcttccgccagccgttccgccgcgagatgcagccgggccagccggtgcagccagtcgcagagatagaacggcgcactgtgcggccggatcagctcgatggcccgctccagcaggtcctgtgccacgtcggtgtcgccttcggcggcggcgacggcgcccaggttggccacctgcacggccaccgccaacgaatcgccgagttcgagtgcgacgcgcagcgagcgcatggcgcagatccgggcatgccggtactcgccttcgtcccggtagatctcgccgatgttcccgaccactatgttggcggtctggcctgctccgatgtcctgtgccacctgaagcgcgttcatgaaggaggcgatggcctggacgtggttggatcccaggaccgacgcgaagccgaggttgcaggcggcgttgagcatgcgctgccggtcgccggactgctcggcggtggtgagggaccgctgcagatgatcgaaggcggcctccggtcgcccggtgtgcaggtagaccaatccggtgtgctcgagcgcggcgctcaccgcggccaggtcgccgatctcggtggccagttccaggtgtcgttgggccatgctgagggcctcgttgtaggcgcctacgcggtagagggcgaaggtgatcctgtccaacgtccggcactgcccggtggcatcgcccaggtgctcgaactccgcgagagcgcgtgacagccaggtgaccggctcgtcgtcggttcgggtgtaggtcagcagatcgccgagctggcgctgggcggcggcgaggacgtcacgtcgtccggtcacccgggccagccgcatcgcctgcagataatggtcctcggcctccgcccactggccggtgtgctgatggacgctgccgatctcgacgtgcagttgggcgcggtccggatcggcgagcaggggcagcaggaggccgtagtagtaggtcgcggtctcgttcgcgaagatctccctggcccgatccccggccttgcggaaccatgcgcgttgcttgtcgacccgttcggtgcgggcgtagtgatgagccagcacatccacgtactgggagagccgatcggcgtactcctcctcgatgaaccggccgatccgttcgtgcagcgccgctcgggtgtcgtaggtgatgctctggtaggccgcctcctgcgtgaccggatgcttgaattcgtattccggttcgggtcccggcgcgatgcgcggcgtgaggtccagggcgtgcaggcgattcaagtgatccgccacctcgggtgcgctgccggcggccgggtagatcgacgctatccagggcggctggaagcgtcggccgatcacgctggccaccttgatggtcgccttctcgtcgtcactgagttgatcgatgcgggccatcacgaggcgctgcagattctccggtacgggcacgccggcgagagcgcggggattccccgtgtcgacaccgcggccgtgcaggtagctgaccatctcctcgatgtagaaggcgttgccgcccgcctgctcggagatctgccggagtacctcaggggcgatgtcggccaccactccgtggcgttcacgaagtcgaagggtggccagttgttcggcgtcacccctggtcatctgtcccaggtgcaggtcagcgacgtgggccggaccgatcagccgttccggtatcgcctcgcgcgaggtcgcgatcatgaggaccggcaggtcggcgatgtgcgggaccagatattcgagaagggccagggacgccggatcgatccagtgacagtcctccagcagcagaacgatcgggccctcctcggcccggtcccggatgcaggccagcagggtcgcccgcagcaactcgtcgcgtccggccggttccagctgcgtggtgaggtcggtgtcctccatcggcaggttgatcaccgtggccagcagcggtgcgcgcagaccggacgtgtcgtagcgggagacccgttcggtcagcaccgtctgctgcatcgagatggacagtgcgggatctatgtcgaggagcttgcggaaaatggagcgccagaccaggtagctggtccgctttccgtgcgatcggcttccccccgcgtattcggcgaagccgagcgctcgggccgcccggagggcttcatcagcgacccgggtcttgccgatgccggcttcgccgtgcagccagaccaggtgcccgtggcccttctccacctgcttggcgaaggcgtccagaaggcccagttccgaggctcggcccaccagtgagccgggcgccgccttcgatctggcggccggcggccccgcttcctgtgcttcgcggacgatccagaccggaacaggctcggctttgcccttcgcggacaccgcggcctgccgcgcattgagcgcgatgtcgccgacgcggtcgtgcgtgacctgatcgatgagcaggtggccggcgggtgccgcctgcatcagccgggcggccaggttgacggcgtcgcccaccacggcgtactcccggcggatgtctgagccgacctcaccgcagtagacccgcccggtggtgacgcctccgcggtagggaccgcccgggagtgccagcaattcgagacaacagcgcagggcgcgctcctcgtcgtcctcgtagctgaccggggtgccgaacaccgcgaccagcacggtgcccttgtcatccgccatcagatggcgcagatggccaccgtactgatcgatgatggcgacgccggctcgcaggaatcgctgcaacgtccggacggtctgcggatcgtccaccgacaggtccggcaaccggacgaacgcggtggtcaccttccggtgctcgttcacgagttcgtgtcggcccgaccggagccggtcgcggatggcggggtgcagaaagggggtcagaagaccttcgagatcggcgatcggcgagacggcggttgccggcgggacgggtacgtccagttcgggtccggccgtgtccagcagaccggggtccacgacgatctccccccgctccgcacggtgcagcgcgctgaccgcctgatccagcgccgggccggcgaccaggtgttgcaggcggatgccggggtcgccgaggaccatgaccagtaccgggcccgaagccatcccgacccggatcgccagggagcgttgaccttcgggggtcggcaccgggtcgacggacgcggtggccatgcggatgatctcggcacatcgcaccgctcgacgcgccaccgtcaacgcggtgtccggggtgtagcggaacaacccgatcagcgcgtccccggcgaagtcgaccacgctgccgcccgcggtgacgatggcctccgcggtcaccgcgaaccagcgattgatcacggaggtgaggcgctcggtgccatagctgcccgagccggccaggctttcggccatggcggtgaagccggccacgtcggcgaagaggatgaccgcgtcggtccgctcggaaaggggcagattgccgacactttcgccggtcctgagtagaccgatggcatgatcaggcaggtaggagcgccaggtagcggcgagttcagccgcgatctgtgacgtgggactggagtcgtcagtcactcctggtgtatccgccttccggatcttatcggtacgttgcatagtcatcgctcagtgcgttgtgttggccagggggtaaccgggacatgcctattgcagtaagcgacgctgccttcgaactggtcggcgcgtgcgctcatgcgcttcggtttgccctcgccgctcctctcgactatccgtatgccgcggccggcatctcgacgaccactccgccgccggcgttgttccggcgggtgcaggtggcgtcgccgccgccggaccgtggtgccgagccgtggcacaccggcctcactctggacgacaagccgttccaggctgacctgcccaccgaccggctgggtgaggtgcgacttgaggatggcattccttcgctcgatctgccggatccgtccagcatcgtactggatcgatggttcagcgttccgcgtcgcagcagcacgattgctttcccgggccgagatttcgggcagtatctcctgtccgttcagtactggaaccctgtcccgccgggggagccggcggtgaccagggacgtcgcctaccacgggacgtaccggttcgagttcgagcggccgccggccggggactggatcgcggtgagcttcgagggcttctggccgcccgagcgggacagcgccgacctgctgattccgctgggcgagtgtgacgacaactgcccgacctgacaagacagaacgggggagcggccgctcggcaccagccgggcggccgctctgtctctgcggtcggcgtcggccccggcgtcgccccgcgccgacggtgatcgcaccccatcactgtcccggcaccggaccgacaggcccctccgggtgccgatcattgcggcgtacgcggtgatcaccccgtacgccgccatcggaccgtgcggaaaaagcggcctggacgtgcgcaggacgccgcgcgcagatatgtacaggggtggggttgtgggttcaggatgacattgaggcccgaggaggtggcgatgatcatcgtggtgatgttgtggctggccgcgctcgccaccggggtctgggcggtgtggccggccaaggagaagaaggttgcggccgtcgcgccgccccggcccgagcccggcagtctcgaaggggtactggtggcgcagctcgtgcgggcggagatcagcgcggcgcagtatcggcgggccgtcgaggggatcgcggcgcgcgacgagcagcggcatccgatgtccgtgccgggggaggaagcctgaacggggtcgggggcccgccgcgccccgagcaggatccctgcccggacggcgcaggccgcccggatctgggccgtcgacgtcagcggaacgagacccgttcccggagcgcccggcgcaggccggccagaccgaggagcagggcggcgaccgcgaccagggcgatcagccaggcggtgaccacgatcagcgggcggaacgggcggtcggggcgggcgtacttgccgttgcccagatccccgatggtgatcgtccggcccagctcggacgcgtcggcgaaaccgtaccggttcgggttcaccatctccttgctgccgtcccgccagaccacgtccacccggcacttgctcgtgtagccgaatccggcgaacgtcagaggtccgtattcggtacacaggtacacggtcccggtgccgacccgctgcgcatcgtcgaaatcggcctggctgtgccgggcgacggtcggcaccataagcccgagcacgacactcgccaccaccagcgcgagtgataccagaaactgtttcacttcggctctccgtacacctgggctttgagttggaggatccgcatggcctgatcctcgatcatccggccggcggcgatgccggccgcatggcagaacgacgcctcatcgagggtacgcaatgtgccttcggcgatggtgatccgccacgtggacatgccctgaacggtgatcgtgatccggccatcgggtgaggtgcctcccgtgaccggggcggagcgtcgctcgcgtccacgaaggccagcggcagcgcggccgtgccgaccggaaacgccgcgatggtggcgatcgccgcgaccgtggtcagcgggacggtccaggtgtctggtcttgaactctcgggcggcccggccgctccacagggtcagggagtcactggccgtcttcgccccggcgaattccggacgcgggtcgcccggcagctcgaagatcgggctcgccgcgttctgtgtggacgttcagcgcgacggtgtggtcgtggtgctccatggctgccctccccgcgggtccccttcatgcgagggaacgccgggagtcgtcggccggttcacccaccaccttcgccgggtcgatccgggtcagcgagccgaagatcgcggcaccctggtaatacacccacgccagcgtgtagcaggccggccggaccggccggcggtatgtggcgcaggtgcgtcggaggtcggcatggaaagcggcatccagacgattcttgttggcgctcaattcgccggccttcttgtagttgcgatagccgaagtcgtgtcgccagcaggggaggcggaagtcgaatccgagtggccggtcggggctggccgaacagtagtcggtgccccagtcgaaatggtattcgtcgggcgcctgccgggcggtgttccaggccgcgaaactggacgcgtccggctgggtgtaggacgccagcacggcctcacgatcgggaacggtcatgcccatggtggctaccgcggcggtgatcagggcggtcagggtgggcgacatccgggcctccagagggggacgggtcgctcagtctggtccgcacgccgtacgcgtcaatcggttgtcgtcgttgtttctgatcggtgtgcaaagcggcacttccggtactttgccagcatgatcgtcgttcgctcgctgctgttgttcctgctcgcggctctcaccgagatcggcggggcgtggctgatctggcagggccggcgggagcaccgcggcccgtggtgggtggtggccggggtgctcgcgctcggggcgtacggtttcgtcgcgaccctgcagcccgacgccggcttcggccggattctcgccgcgtacggcggcgtcttcgtggccggctcgctcgcctggggtgtgctggtcgacggcttccggccggaccgctgggatctggccggcgccgtcatctgcctgatcggcgtcaccgtgatcatgtatgcgccgcggtgaccggcggggtcagcccagcacgatcggctcgaagatcgaggagaatcgctgctgctcctcggcggtgccgaagttcacgtaatagtgcagcttcgcgtagtcggtctcgctcgggaagaccaggtcgctcttcgcgaccagctccatgtcgctgcgatcggttccggacagcttggccgcgtccttgaggatctgcgcctgcgccgccggcaccgggcaggcgtagttgatgtattccgccagcgacgccgcgttctccacccggtaaaagaagttaatcatcatgagggcgtcgaccgggttggcggcggtcaccggaatggcgaaattgtccgtccagatcgtgccgccctcctgcgggatcacgaacttgaggttcgtgccgtcggacaggttcttctggaagacgtcgccggaccaggcctgggtcagccacacctcgcctttgccgagcgcgtcgacgtaatcctgctcgtaatacttccggacgatgccggcgtcgcgctgctgcttgagtttcgccgccgccttcctccaatccgcctcgttcgactcgcccggcttgacaccggcggcgagcaggccgaaattggccagttcggtgctgtcggacatcatgccgaccttgcccttgaacttcggatcccacagatcggccaagctggtgatctcccggccggtcttcttcgggtcgtacgcgatgccggtgatcccggaggcccacggcacactgaagacattgcccgggtcgaacgtctcggtggcgtatttcgggccggcgttcgcggtgaagttcggcagccgggaatggtccaacggcgccaggaaaccggccgcccggaactggccgaactggatgccgttggtgatcaccatcaggtcgtaaccgatcgactgtttcgccgagagctgcggctgcaccttggcgaaccaggggcccatctcctggatgacctcctgatagttcaccttgatgccggtctccgcggtgaaacgggtcagctcggggtgcttcgggtccatgtagagcggccaattcgcgaaatcgagtctgccgttcttcgctttaccctgccagaatgtggccagggcgtcggcgtccacaacggccgcgggcgtgcctcggcccggcaccccgcacgcggccagcgcagcgccgagcgcggacagcccgccgagccgcagcgcgtcacgccggccgagtcgtcgcccggtcgcgccgcgcaggagggacggggcgggggtgctgcgcggaaacatcagactccgatcacgggcggggatttcggcggctctgtcgcgggccgccgcacggcgacacactggtccgatcgtcggcaaaccgtaacgatcccgacggcctgtcaagatcatcttttcggtcgcgagccgtcgtccgtttgcggcccggcctcctccgggacggccgtccgccctcgtccgctccgccaagatcaagatcccgattgcggtgtacgccgtgccaccgcccgcctcgccccgccggcgttccgccgcgccgtcccttccgtccgcgccgtcccttccgtccgcgccggctccgggttcctccgctccggtcgtccgggccggctctgggttcctgctccgatcgtccgggccggctccgtttcgggctggtccctgtcgtccgtaccggtcctgtttcgcgtcggtccttgcgccgtccgggcctgttccgtttcgcgtcgagctgccgtccgggtcggttcctttgcacgcggcccgaggggccgttcccgcggcgcaccattcgcggcggcccgcacaatggggtcgcgtaggcgtgctagctttcgtttccatgcgcgtcgacgacgctcgcggaaaggcagatcccatgcatccggacgtacgcgtggcgcaggccggcccagtcgacctggacaccgtgaccacgctgttcctgggctatctcgatttctacgaggcgcccgcggaccgggccgaggcgcgtcaattcctcagcgaccgcatgacccgcggcgaatccaccgtcctgctcgcccggatcggtgcccaggcggccggtttcacgcagctctacccgtcattcagctcggtccgccgggcgccgatctgggtgctcaacgacctgttcgtcgacccggcgttccgcggcagaggcgtcggccgcaccctgctgcgcaccgccgccgacctcgccgaacagaacggcgtcgtccgcatcgaactgtccaccgacgaatcgaacagcacggcccaggcgctgtacgagtccgagggctaccgcaccggcttcccggtccgccactaccttcgccgcatcggcgcctgaccgcccagccgcctcggcgcggggagggacgtctgaccgccgagccgatctcgcgcggtcggtggacccttgaccgccgagccgattccgcgcggtcggtggacccttgaccgccgagccgattccgcgcggtcggtggacccttgaccgccgagccgatcccgcgcgatcggtagaccccctgaccgcagggccggccccgtgcgggagccgcggacgcctgaccgccgggccggccccgtgtgggaaacgtggaggcctgaccgctgagcgggtcatcggtattcatggcacccgatcgctgagtcggcccccggtgcggagggcacggcgtctggcccgtcgcaccggtccggcccgggcggtgcgacggcctgcttccgggcgctgcctcaccggcgacagcatgcggcgggtggggcacgaaagcagccgcgggacgccctcggactgtcgagagcgccccgcggctgatcggtgccgggtcagttgccggaaatggaccagtgccaggcctcgaccgggaagttgacgaagccgtacgtcttggcgtgtgccgtcagccacttgaacgcggccgtcttcgacgagatggtcctgcctcccgacgtgatgtcgacggccaggcccagctcgtgcagggagcgccccgggatcgcggtcggcacccggcacgacgacgacggcgccgtccagacgtcggggcagccgttgatggtgcgcagctcgatctggcgctgggtggtgcggaaaccgcccccggaaagctggacgccgtccgccttcgccgcgtcgatcatgtgctggaaggcgaaggcgacactgcggtgcacggtcacgccgtacacctgggtggtgtcctcgatcttgaagttggcccggacctgggtgaccacgtccctactgagggcggcggcctgaccggccagcgacgcggcggtgggcagcgcggtgatcgcctgctgggtgcgggtgacagcggtcgccccggtcgccgcgccggcggtggcctcggcgatccgggcgcgagcggcacgctcggccttggcggcggcggccaggtcggcggcggtcgtctgggtctgcgccttgcgaacgccgaccgtcttggtggccgcggtgaccgcggtggtcgcacggatgaccccggtggtggcgcgggtgacgcgggtgatggcccggtccgccccggccgtggcctgggtgacaccggcgccggcctgggtgaccgcggtgccggcctgggcgaccgcggtggtcgccgaggtgaccgcggtggtcgcccgcggaacggtggcggtcgcgtggttcagcgcggtggccgcccgggtgaccgcggtggtcgcccgcttcaccgcgacggcgttgcgcggattccgccggtcggccgcggccaggttccgcttggcgagggtcaggttctgcttggcggaagccaggttctgcttggcggtggtcagattccgcttggcggcgaccaggcgctgccgggcggcggtcaggttccggtcggcggtggtgaggccgcgcttcgcggcggtcacggtgatgccggcggcggccagggtctgcttcgcggtggtcagggtctgcctggcggtcaccaggttctgctgggcgccggtcagggcggtgcgggcggcgctgagatcggcgcgggccctggtgtccgcggtggtggcggtcgccaccgtggccagtgccgtccggtccgcccggttcgcggccgctgcctcggcgttccaggtgcggaccgcggcctgctggccggccagcgaggtgcgcatcgccgcaagctgcgtgtcgtgggtgaggctgcggtacatcaggctcgaccagctggccgccaccttcggcaccgcggcctgagccggtgccggcatgccgatcgccgaaccggcggccgtcagcgcgatgatcgccgcggcggcggacttccggagagttcgctgtcgtgtcgtcacccgaagactgtgaaagccgccgggttcgacctccggtcccgatcaggaccgaaaaggttgcaagaatccgcaccccttgcagcccgacccgaccaccacccgccgtcccgccggccgactaccatccgccggccggctccgtccccgcctgccgccttcgtcccgcccgccgagtgtgacccgccagccgggtgtgacccgccagccgggtgtgacccgcttgccggcttggtcacgccggccggcttcgttccgccagccaggtgtccgcttgccggctttatcccgcttgccggcttcgccccgccggccgagtatgtcgcgccagtcgactccgtcccatcccagcggcgccgagcggtgcagtccggcccgcgccgtgcccgggcccgtcccgggctgcgccgcccggtgcgccttgcgttggcagccggcttgcgctccggtgcggtttgccgactggtgttctatgaggctcgccgagcggccgagtgggccgtgcaggccgagtgggccgtgcaggccgagtgggccgtgcaggccgagtgggccgtgcgggccgtgtaggccgagtcggccgtgcgagcggagtgggccctgcgagccgagcgggccgagcggcgccggcagacgcgttttagttgggggtgaagaggccttcgatgccgacgatgatggcgatcacgccgaagatcgcgatgaccagtgcccggcctgcgggttcggccggtcccggagcctccagaattcggcgcccggtgaacttttcccaggtcagtagcagccccacggcgattccgaccacctcgaagtgccagatgtgcccctcgaagaggtgcacgatcaggaagtagcccgccgcgatcagcgccacgatgccgatcagccaggcccagcgggcgacccggtcggtgaagcgctccaagttgtcgcccacgttcggcaggcggcgcaacagggggatcgccagcagcaggccgccgaggatgttgcagagatcgagcaggaacgccatggcggagagcgtaatgggagcgatcccagcccgctactcgagcgctgatcacttacggacttcggtggccgagctggtcaaacgccgagctttccgtccgcgccccggggatcgagagaggaggccgtcagtgcccgcgggccggtggaatcggccggcttcaaggcgacggcgttggtctccggaagccgcgatggagcggcaagggtgaagaggcaagggcgtaagtaggccggagccctcgtggcgtcgacgaggccaagccgcccctgcgcagcaggggcgggaatcgcccggtgggtggggctctgggcgtgcacatggtggtctatcgggtggggtggggtggggtggcggcgcgttcggaggggcgcggtggtttggcgggtgagggaggggtggggctgatgagcgttaggcgtgatcgcggtggtgtgtcgggtcagggatcggtgggtcgtgtgggcgttgggcgtgggagcggtggtgtcaggtaggtcgtgtgggcgttggccgtgggcgcgctggtttggcgggtcaggcagcggaggtcggtgaggcgtggggcgtgggcggggcgctctgtcgggccagggagccgcggggtgcggggcgttggccgtgggcacgatggtttgtcagaccagcgagaggtggcgcggggcgaggctgactcggacgcgctggccccaggagagctccagggcgtcggactccaggccgtcggcgaagacgaccaggcgttcgctttcgctggtcagctccagctcctgaccggtggtgagaaggccggagacgcaactgacgccggtgaccggggagggccacgcctcgcggacgaaccagcacagggccgggtcggccggggctggcaggggaggggcggtggcgcggtcgcgggcgatcgaggcgcaccagccggtggcgccggtgccggtgccgacgatcaggccggaggaggactggcgctcgcgggtgccgtccggggtggtgatcacgtatcgggcggactgatggccggcgtgaccgatgtagatctcgttgaggccggccagctcctgtccgtcgtcgagccgggcgaccaccatggtgcgctgctggcggggcaggctgccgcggagcagccggccgaccgccgtcgcggggtggcggaccaggacaccggggttgcggccgggctccgggtcgacgccgatcaccggctggccgtcgagatatttcgcgacgttggcgaccagaccgtcctgcccgacggcgatgaccacgtcctccggggcgaacaggaagcgcggcaggtcggcgcgctcgacgtggccgcgccgccagtcggccgggatggcggccccgacctgggtcagtgcctcccgcagcgcctcgtgccgggtggacacctcgtcgaggtctcggccgcgctgtttcaggaagtaggccgcggcgccgcgggtgccgtgccgggcgagcagctcatcgagctcgctgcgccgcgacacgatcaccacgcggggggtcaaggtgctcaccagaagatcctccaataccgctcgtcaccatgggcccgcggcgagccggccgccggccgcggatcgggcccgagcagtccggccggcgcgccgggactgctcaggcggcaggccgcccgcgcaggctgatcagcgtgccggggttgcctgcgcggtggtccatttgatcagcccgctgagggtggtcaggagccgatgcggccgaggagcctggtgagcatgtccggggtgacggtgagctcgccgatcgccgggaggtgctgggccagctcgcgcagggccagcgcctgcagcacctcgggcggcaggtcccggtaggccgcgaggcgggccgcctcggcctccgcctcggcctagctagctagagccgcgcccgctcggcctcgccctgggctgccaccagctgcgactcggcgtccagctcggcgccacggcgggcgttggcgccgtgctgctcgaccaggtgctgctcctgccgggcgagctcgatcttgctctgcagctcgttctccgcgatggagcgttcctgctggacggcgtgcgcccgccgggcgtaggtggcccggtcggcgtcctgctgcaccttttcccgggtgggggtctgcagcgcgcgctccaggtcgggctcgggacggatcgccaccacccgggcgctgaccacggtcaccccggtctcggccagccgcgggtcggtggccagcgcgtcggcgacgccctggcggaccggggcgatgccggtggtcagcgtctcggcgagcggcagccgggcgatcaggtcgagcgcgggctgctgggccagctcggcgagcagtgtggcgacctggtcgaggggctgaccgtgccactgtccccggtaggggtcgatggagaagtcgagccgggacgctgcggcggccgggtcgctgaaccggtaggtcaccgtggcctgcacggtcacgtcggcgaagtcctcggtgcgggcgtggaacagcaggggcagctcgcggtcgtcgaccggcacctcggagaggaccgcggtgagcggccgataccagaaggcgagcccggtgccggcgcgcttggcccggccccgcacggtgtagctgacccagctggtcggggcggagcgcaggtggcgcaggtgcaggcggcgcttgatgtcggccatcggggggtccttcctcgttttcgtcacgatgacgataaagcctgcgagctattatcgtcaacatgacccttaatgcgatggcggtcacggtcgacctggtcctgctcaccatccggcagcagcggctgcaggtgctgctggtccgccgcggtatcgagcccttccggggcggctgggcgctgcccggcgggttcgtcctcgacgacgaggacctcgacgacgccgcccgccgcgagctgcgcgaggagaccggggtcgacgcggtcgccggtcacctggagcagctcgggacctatgggcggcccggccgcgacccgcgcgggcgggtggtgacggtggcctatctcgcgatgctccccgacctgccggccccggtcgccggcagcgacgccgccggggccgcctggcggccggtcgacgaggccggcgacctcgccttcgaccacgaccggatcctggccgacggcgtcgagcgggcccgtgccaagctggagtacacaccgctcgccacggcgttctgcccgcccgagttcaccgtggccgatctgcgggtggtttacgagtcggtctggcaggtgcagttcgacccacgcaacttccatcgcaaggtgaccaccgcggaggatttcatcgagccgaccggccacagcgtgacccgcgagcgcggtcgcccggcccagctgttccgccgcggccacgcgccgctgctgcacccgccgctgctgcgcccgggcagtctcggccaaaagtcgtaggggtgatgccgcctcctcaccatccggcagatgcacagctgttgcacaggcacggcatgctgcgatgtgcacggctcgggggaggcatggatgacgatggtgatggaacggacggctgaggtgcggccgctgccgcagcggtgggtgcgcccgccgtcgtcgcgtcgtgtggtggcacgggtcgtgcagttcgtcggcgcggtcagcgcggtgtcctcggtgctgcccccacggcaccaccaggtggcgctgctggccggcatgatcccgacgaccgggctgctcaccgcgcgggtggcctccggggtggtcggcgtgctgctggtctatctcggttccgggctgcgccgcggcaagcgccgggcctggcaggtcgcgctcaccctgtcgctgatcgcgatcggcctgcacctggtcaagggcgggctgatcccgatggcggtggccggcgggatcgtggcactgctgctgtcgcgccgccacgagttcaccgccgagggcgatccgcgcaatcggtggcgggcggcgcgcgcctgtgccacgttcctctccgcgggcttcgccctcggtttcgccgagatcgccgtacgcgtcgatcacctcaccggccgccccggcgtgctcagctgggcggcccacgcgctgctcggactggtcgggatcaccggcccggtccacttcgtctcgccgctggccgatctcacggtgacggtgaccaccggggcgttcgggctgctggcgttcgcctcggccgcgctcctgctgctgcggcccagcaccggggcggccgcgtcgcccggtgacgacccggcgcggctgcgcgccgtgctcgaccggcacggcgacggcgactcgctcggctatttcgcgctgcgcagcgacaagcagctggtctgggcgccgtccggccgggccgcggtggcctaccgggtggtcaacggggtgagcctggcctccggtgacccgctcgggctgccgtcggagtggccgcaggcgatcgggcagtggctggccgactgcgcccggcacggctggaccccggccgtgctggcctgcggcaccgccggtggccgggcgtatcagaagaccgggctcgacgtcatcgagctgggtgacgaggcgatcgtcgacgtggccgggttctcgctggacgggcggccgatgcggggggtgcggcaggcggtcgcccggatccgccgggccggctacacctgcgccgtgctgcgccagcgcgatctgccggcggagacgctggccgaggcggtggcgtgcgccaacgcgctgcgcgacggcaaggtggagcgcggcttctcgatggccctgtcccggctcggcgatccgggcgacggcgactgcgtgctggtcctctgccgcgacgaggagggcacgctgcgcgggctgctgcagctggtgccgtggggacggcgggggctgtcgctggacctgatgcgcggtgaccggacggcgccgaacgggctgaccgaactgatgatcgtctcggcgatcgaggcggcgcccgggttcggggtggcccgcatctcgctgaatttcgcggtgctgcgctcggtgttcgcccgggccgaggagctgggcgccgggccggtgatccggctgtggagccgggtgctcagggcggcgtcgcggctgtggcagatcgagtcgctgtaccgggccaacgccaagtatcagccggactggcagccccgcttcctctgcttcccctcggcccgcgacctgccccggatcgcgatcgccgccctgcgtgccgagtcgttcctccccaccggcggcccctcctcgatcgcagcctgccccgccacaccgccggcccaggtcgccgagggctcggcgacgcagaaggcgcaggtcgctgagggctcggcgacgcagaaggtgcaggtcgctgagggctcggcgacgcagaaggtgcaggtcgctgagggctcggtcgacggatcggccacaccgcccgccgaccccgcggggggagcggccaccccacccgggcccgcacccggacctgtcccccggcggccccgccggggacggctcgtgagactgaccggcctgccgctgctgctgctcaccgccctcctgctgatcgtcgtcgccgccgccaccgcgcgctggtggcgctcggcggcggtccggatcaccggcctgatcctggccgaggtgctggtggtggccggtgcgggcctgatcgccaaccgcagccagaacttctatccgacctggcaggcgctcgccggccacgtcccgccggtggcggtggcggccagcaccggcgcctagctagctagggcggccagcaccggcgccggccggctcgacgcgcggctggccgccggcggcccgatcgcctggtcaccgcccgaggcggccggctggcacctggccgccgcgccggtcctggtggcctccccggagtacacccgggcccccgaccgcctgttcccggtcgtcgtggtgctgtgcggggccgccggcgtaccgcgggtgcaacagtgggccagccgggcggaccgggtgctgaccgtcatcctggtgccgacccgcgcgacctccggcagcgcgctggcgagcctgcccagcagcctgcgccgcgacgcccgtgccggaaccgacgtgatcaccctgcacgacccggatccggccgatctggacgcggccgtgcgtgaccttccggagccgctggcggcgccgctgtacctgccgccgccgcggctggcgcacgaggtgcggccgtgaggatcgacgcgcccgccacggtcctggtcaccgtggccttcaccctgctcgcgacggtgtcgctgggcctgctctggaggcgggcccggctgctcacccggatcgggctggccgctctggtgctcgtgctggtgaccgggtcggccgggctgcagctcaaccggatgaccgagacctatccgacctggggcaccctcgccggtctgccgagtccggagatgcacatcggcgaacggctggtcagctatccggtgcggggcccggccagcggcctcgacatgaccatgaccgtgtatttcccggccgcctaccgggcggatccgcggcgccggttcccggtgatcgaggcgctgcacgggtttcccggcacgccgtcgacctgggtacgccggctcgacatcgtgcggcatctggatcaggagatcgcgtcgggtcggatggcgccggccgtggtgctgctgccctatctgacgccgcggcggctgttggacaccgagtgcaccaacctggtcggcggcccgcagacggagacctatctgacccgtgacgtgcccgagtggacgatggcgcacctgcgggtccgggcggaccgggcggcgtggggcctgaccgggtattcggcgggcggcttctgcgcgatgaacctgctgctgcggcacccggaccggtacgcggcggcggccagcctgtccggtttcgccgatccggggatcaaggtgggcgaccacagcgaggcgaccacgaacaacgtcgcgtggcgcctggaacacctgccccggccgcgggtggcgatgtggatcggctgggccgccgacgaccacctggcgcgcagcggctcccgggaggtggtgcaggccgcgaaggcgccggtcaccgtggtcaccgcggtggtgccgcacggcggccacagccatgcggcctggcagcagatggagggcccggctttcgactggctctccgcccatctggcccgcgccgaataggggccagactgatcgagtacggccctcgaccatgtcgatgccatgacggttccggaaccggaatgtattgacgcgggtgtaaagcggaaacaattctgggcgcatgatgcggcgcggtgtggcggcacttgttccagcgatcctgctcattccgggcccggcggtggcggccgtggggcggcccggtggcggggaaccccgggcgcgggtgtgggtcaccacggtggaccgctcggagttgctgcacgagcggtcaccggtcggcttccgccgggggagcagcgcactgaccacgatcacggtgaacccggagcggaccttccagcggatggacggcttcggggcggcgctcaccgatgccgcggcgagcgtgctctaccggctgagcgcggcggaccgtgccgacgccgtacaacaattgttcgatcctgaaaaggggatcggggtcagcttcctgcggcagccgatcggctcgtccgacttcaccgccgcggccgcgcattacacctatgacgacgtgccggccgggcaaaccgatttcgggttgcggcatttcagcgtggagcacgatcgggcgcagatcctgccgctgctgcgcgcggcgcgccggctgaatccgcggctgaccgtgctcgccacgccgtggagcccgccggcctggatgaagaccggcggctcgctgatcggtgggcgactcagggacgacccgcggatctacgacgcgtacgcgcggtatctggtgagattcgtccaggcctatgccgccgcgggtgtcccggtcgactacctgaccgtgcagaacgagccgcagaaccggctgcccggcggctatccgggcaccgacatgccggtgcgccaggaggcggcggtgatcgagcggctcggcccgctgctgcgtcaggtcagcccgcgcacccggatcctgggatacgaccacaactggcagacccacccgggtgatgtcgggtccaccccgcccggcgaggacccggagaccgactacccgtaccggctgctggactccccggccgggaagtggctggccggaacggcctaccactgctattccggcgatccgggtgcgcagaccgccctgcacgaggcgcacccggacaagggcatctggttcaccgagtgttccggttcgcacggcgccggcgacaccgacgagcagatcttccgcggcaccctcacctggcacgcccgcacgctggccatcggggtgccgcggaactgggcgaagtcggtggtcaactggaacatcgcgctggacagcggcggcggcccgcacctgggtggctgcggcacctgcaccgggctgctgaccctgctgccggacgggacggtgcgccgggacgcggagttcttcaccatcgggcacctgtcgaagttcgtccggcccggcgcggtgcggatcgccagcacctcgttcggcaccaccggctggaacggccagatcatggacgtcgcgttccgcaatccggacggctccaccgcgttggtggtgcacaacgagaacgacgagccgcgcagtttcgcggtcgcggtcggcgcccgcaccttcgagtacacgctgcccggcggggcgctggccactttcgtctggccgcgctcggtaggcgcccgccccggcgagatcccgctgaccggggcgaccgcggtcgccgtcccgccgggcgagggcgcgccgctggccgtcgacggcgacgcgtcgacccggtggtccagcggggcggcccaggcgcccgggcagtatctgcaggtcgatctcggcgccgaccgggtgttccgccgggtggccgtcgacagtggggacaacctcggcgattacgcccgcggctggcagctgtcggtcagccgggacggggccacctggaccacggtggccgccggcgccgggaccggtcagctgaccgaggtggcgctgcggccgacccgggcccgctacctgcgcatcacctcgaccggcggcagcggcagttggtggagcgtggccgacctgcgcctgtaccgctgatcagggccgcagcagcggcaccagcagttcgagcgcccggtccaggctctcgtggtgctcggcgcagtcgtcggtgctcaccgaccaggacggcgtgctgatccggtagcggtagccgtcggcgcagattccggacgatgcggacgggatcgggtcggcggtggcgaggacctgccggagtgcgtcgaggacggtccggtcgacggcgaccgggccgctgctgccggcaccctgccgggtgaccgtcatccggccgtcggcgtcgatgtgcaggcggtcgctgcggccggcgaatccgccgctgcggctgaagtccagcgggaagacccggtcgggcgcgccgctgacctgcggcgtcgagccgccggcgggggcggcggcgcaggcggcgacgagggtcagcaggagcacgggggcgaggagtcgcgtcataccggtatgacatgcccagcggacgtccggttcccacctgaggtgaaccggctgaagtgaaccggtggggtgaatcggctgcggtgaaccggctgaagtgaaccggtggggtgaatcggctgcggtgaaccggctgaggggaaccggacggaaggtggccgcaggcgggccacctcccggatcaccggatcaggacttctcgagcgccgcggcggagcggatgtcggcctgatcgaccgccgccagcgaaccgaagttgtgcaccgcctggtaatacgtccaggccaccgagttgcaggccgcctgtgacagcgtcgaataggtggcgcacttgcgcttgaggtcggcgtagagcatcgagtccagacggtccttgttggcgtcgaacgtgccgaccgccttgtagttgcggtacccgaagtcgtgccgcgcgcaggacagcttgaagtcgaagccgagcgggttgtccgggctggtcgtgcagtagtcggtgctccagtcgaacccgtagtccgaccaggcgccctggttgttgcgggcggcgagccagctggtgtaactgcccgcgctggtctgggtgaagccggacaggacgctgagcttgtcggcgggggccgcggcggccggggtggcgacggcgaccacggcggtggcggtcacggcggcggcgaacagggaacgaacggcggtgggcatccaggctcctcagtcggtcgggctgccactgagggaaccgaaatgctcttgcgatcatctatatctaccggaggtagggttgatcatcgtgagcgcatcgatcaacgacagacaacgccggcagcacgccacgtcgttcggagccgccgcccgcgagtaccggcgcggccggccgccctacccgcgggaggccgtcgactggctgctcccgaccggcgccgccaccgtcgtggatctgggcgccggcaccggcaagttcaccgagctgctggtcgcccccggccgtgaggtgatcgccgtcgagccgtccgccgggatgcgcgagcagctggccgacgcggtgcccgccgccaccgtgcacggtggcaccgccgaacggatcccgctaccggacgcgtccgccgacgcggtgctgatggcccaggcctggcactgggtcgaccccgaactcgcggtcccggagatcgcccgggtgctgcgccccggcggcaccctcggtctggtctggaacatccgggacagccgcgagccgtgggtcgccgagctcgacgacctgctgcaccaccacagccgtcaggacctcgacaccgcgccggaactgcccgccccgttcgccgccgccgaacgcgccgagttctcctggcggcacaccctgacccgggacgcggtgctggacatgatcgcctcccgcagctacgtgatcgtgctgcccgagccggaacgcgccgaactgctcggcaacgtcaccgaactcctcgcctcgcaccccgatctcgccgaccacgacgacatcgtgctgccctacgtcacccgctgcacccgcgcgacccgctgatcccgccggcgcgcggagaaggagacccgggagcgcggaggaggagagccgggagtacggagaaggggaccctggagcgcggaggaggagagccgggagtacagagaaggagagcccggagtacggaggaggagagccgggagtacggagaaggggagccgggagtcaggccgggcgccgggtcaggacctgtggtcccgattcggtgatggcgacggtgtgttccgagtgggcggtgcgcgagccgtcggcagaccggatggtccagccgtccgcatcgaacttgatcttgtcggtgccgcggcagaaccagggctcgatggcgatggtcaggcccgggtcgaggcgcatgccgcggcgggcgcggccgttgttcgggatgtgcggggcctcgtgcatggtgcggccgagcccgtgcccgccgaattccagattcaccgcgaggccgtacgcgtgggcgacctcgccgatcgccgcggagatgtcgccgaggcgaccgccgggctgggccgcggcgatgccggcttccagggcgacctcggtggactcgatcagtgccaggtcgtcggggtcgggctcgccgacgatcaccgagaccgccgagtcggcgacccagccgtcgatgccgaccgccatgtcgatgctgagcaggtcgccgtcgcgcaggacgtagtcgtgcggtaggccgtgcaggaccgcgtcgttgaccgacaggcagagcacgttgcggaacgggccgcggccgaacgacggggcgtagtcccagtagcaggactcggcgccgcgctgctcgatccggcggcgggcgtggtgttcgagatccatcaggttgacgccgacggcggcggtcccgctcagctcggcgagcaactcgccgacgaactggccggtcaccgccatccgggcgatctcgccggtggacttgagttctatcacggtatttttataccacgcgtccggcaggggttatcctgctggcatggtgcgccaaccactgacccccgagcagatcgccgcgggccggcgtctcggggccgcgctgcgggccgcccgggccggtcgcggcctcgtcgaggtggcactggcggccggcatctcaccggagacgctgcgcaagatcgaggcgggccggctgccggcgcccgcgttcggcacggtggtctgcctgagccgggccctcgacgtcccgctgggtgacctggccgacgtctggctcgccgacaccgcggtcagccgcgcgtcctgacccactcagcaggccgggcgcagctcctccgagcgcatccgcgggtcgaaggcccggcaggtgcccggcatcgtcttcttcgcccggtacatcgccaggtccgcgtcctccaggacgtgcgccgcgctgcgccccggcccggtgtaggcgatccccacgctggcccgggtcagcaccgcccgcccggcgatgtcgaacggccgcgcgatcgcgtcgaccacccgctgcgcgatctcccacgcctgcgcctcgccggtgatcggttcgagcagcaccgcgaactcgtcaccgccgaagcgggccgccatgtcggtgtcccgaaccgcgccgaccagccggtccgccaccccgcgcagcagctcgtcgccggcggcgtgcccgagcgtgtcgttgacctgtttgaacaggtccaggtcgaggtagagcagggcggccgaggcgttctccgccagggacttctccagccggcgcaggaacagcgcacgattcggcagccgggtcagcgggtcgtggtgcgcctcgtgcaccgcggccgcggtgtgcgcgccggtcagggccaggctggcctgctcgctgaaggcggccagcacgtcacgccgctccgactcgcgcacgtcaccgccgtgcccggcgaacaccagtgcgccggcgagccggtcaccccggtagaccggcgccccggtcaggtcgccgtcgacgaccggctcgccggcggccatcgtccgctcggcgagcagcagcaccgacgaccggtcgtagggtccggcggccgacgccgggtcgtcggcgtcggagagcaccaggacgaccgccgcgtccggtagcagccgccgggcctccccggtgatcgtgtcgagctgctcgtgcagcggggtgccctggccggccgcccgctggatccgcagcagcgtctccagcagccgttcccggcgttccagcgcccgcaccaggaccagccggtcctcggcctcccgctcgcgttcccggcgcagctgctgctcggcggcgagggtgcgcaggctgcgcagggccagcccgagcaccttcgccatgccctgcagcatctggcgttcctcggcggtgaacggctcgtcggtccgggccaccaccagccgttcggtgttgtcgccggccagcgcgtgcatgctcacgtacgcctcgccgacgcccgggaaggccgcggtctccgagcgcaacccgaggaacagcgccgggtcgggggagcggcccagcccgaccgacgcggtcagggtgtcgccgcagaccaccgcgcccagttccgcgtcggtggcctcggtggcccgctgcaccgcgacccgggcgacgctggcctcgtcgccggcccgggtgacggcggtgaagtattcgctgatctgcagcatcgaccaggtggtcatggcgacccgatcagctcagcgcgagggcggccacggtcaggtgatgcatccccttcgccccggcctgccggatgatctcgccgttggagtagaacccgccgaacggcaccggcttcagggcgtcccgcaggcgctcggtggccagctcggtgctgtcctcgcccagcgcgatcggacgtacacagcaatcgaagaccaggaccccgagcggtgccgcgccggacagcgactccatcgcggcgcggcccgcggccgccgccgcgccgaccacctcgtcggtctcgccggccatgaaccagaccatcgcgccctcgggcgtgtcggccaggccggagatggagcgctccgcggcgtcgcacgcgaagatgatccggatgtcctcgccggtgcgccgggccagcccgagcggccggatcgtggcgaactgcaggaacgccgacgggtcggcggacagcccctccggcgccccggtgcggcgcaggtagacgtcgagcgccggctccccgtccagctcgtagatcttgccgccctcgctgcgggtcaccaccatcggctcgtcgagccggtgccagccgtgcgccatcccgatcccgaacggcgacggcgcgccgagcgccgcgccgagcaccgcgttcggcagcacctgcaccggaccgccgtcgctgaagaacgcgaacgtgccggtctgcgtcacgttgtcgcccgcgcagccaccgatcagcggcacctgggcgccgctgaccgcgtaggcaccgcggaccacctcctgctggtcgccgctgcgcccgtcgccgagcatcagcagcacccggtgctcggcgtccacgtcgtcgagcgccgaggccaccgtctcgccggcggtgtacaggtcgacgctgtcgtgcggcaccgcgcgcaccgccgcggtgtagccgccgagcgcgttgaccaccacgccggcgccgccaccgtccgacgtgtactccccggacgtcgagcagccgatcatcagcacgtcaccgccggccgcggcgtgcaccgcggcggccatctccggtgtggcgtgggtcagcgaggcgaagacgatcaccaggctggcgcgccggccgccgagcgcctcgcggcaggcctggcttccggcctcggccgggtcggccagcaggctgcgcccgaccccgaaccaacgctctgcgtccatgtcccgctccctcgccgccggggcccgcggtggcaggcctcccgggattcctgcatcggcggccgccccgtcgatctgagcggaaccgggcatgatggggcgcatggattacgaaaccgcggtgggctcgctgttccaggccgaggggcgagaagatccctacccggcgtacgacgtgatccgcgcccacgcgccgatcttcccggtcggcgacgaccaatggttcgtgacctcgcacgcgctggtcagccggctgctgcgggatcccgggctgcgggtggccgaccgcagcgactacgaccggcactggccggactggcgggacaaccgcggcgtcgcctcggtggtgctgtccatgctgcagaccaatccgccggaccactcccgggtgcgccgggccgccgcggccaccttcaccgcgcgccgcgtcgccggcctgcgcgacgtgatcacccggcaggtcggcgacctgatcgacgagatgccggccgaggccgacttcatcggcgccttcgcctatccgctgccgatcgcggtgatctgcgcgctgctcggcatcccggacggcgagcgccgctggttccggcagcgggccgccgacctgaccgtggtcctggagccgatcagcacaccggaggagatggcccgcgccgacaaggccggccgggagatcgaggcgtacttcaccgggctgatcgccgaccgccggcacaccccgcgcgaggatctgaccagcgcgctggtcgccgccgcggagaccgacctgaccggcgaggaactgctggccaacctgattctgctgctggtcgccggcttcgagaccaccaccaacctgctcggcaccgggctgaagatcctgctcgagcatcccgatcaggctgatcggttgcggtccgacgcggggctcgcgcccgctttcgtcgaggagatcctgcggtacgactcgccggtccagctgacctcccgcttcccgaccgagccactcgacctcgacggggtgcgggtgcccgccggcccgatgctgaccatgctgctgggctcggcgaaccgtgatccgcagcgctaccccgacccgcaccgcttcgacccggaccggccgaacatccagccggtgtcgttcggcggcggtgcacactactgtctgggcgcgccgctggcccgactggaggcgcaggtggccttcccgctgctgctcagccgcctgcccgggctcgcggcggccggcgcgccggtccgccgcgaccgtctcgtgctgcgcggatacgccgccctgccggtcaccaccggccgctgagctcactctcgaagaagtccaggaacccgtccgggtcggggccggcgttcatcagcaccagatgatcgaaaccggcctcgctgtaggtcttcaccgcgtcccggtaggcctgcgggtccgggccgcagacgaattgccgctgtacgtcttcggggcgcaccgtctgggacgcggcgtcgaagttgaccgggttcggcagctccgacatcaccttccagccggtgaccgaccagcgggaggtgcggtgcgcctcggcgaccgcggcgtccacggtgggcgcccaggccgtcgcgatctccgcgtacctaggccccgttccgcctttttcctgaaatgtcgtgacgaggtcggcccggggttcggtggcgaacaggccggagccgtgcgtggcggccagctcggcggcctgcttcccgcccgccgccaccgcgatcaccggcagctcgtccggcaggtcgaacacccgggcgtcctccagctgcagatgcctgccctgatacgaccggtagccgccctgccagagcaggttgatgatgtcgagggcctcggccagcatctcctgccggaccgcgaccccggggaaaccccggcccaccacgtgctcgttgagccgttccccggagccgatgcccagcgtgaaccggccgtccgagatcagcgccagcgtcgcggccgcctgcgcgatgatcgccgggtgataccgcaccgtcggacaggtcacgccggtggccaggccgagccggtcggtgcgggccgcgatcgcgctcagcacattccaggcgaacggcgaatggccctgctcctccagccacgggtggtagtggtcgctcatctcgacgaagtcgaaaccggcctgctcggcgcggatcgcctgacggatcagctcctgggggccgaagccctcggccatcagcttgtatccgatacgcatgccctcgggcttccctggggcatgccgggtaaacgttttctcagacgcgttccagcaccaccaccggaatctcccggtcggtcttcttctgatactcgtcgtaatccggccagacctcggccatcttcgcccacatctccggcttctcctgcgccgtggcgacccgggcccgtgccgggaaccggtcaccgcggatctgcacctcgacccgcggctcggcctcgaggttcacgaaccaggccggcggggccgcggcgccccccttggaggccaccaccaggtaggcgccccggtgctcgcggaagatcagggcgtgcgagcgctgctcacccgacttacggcccttggtgaacaggatcaggatctcggtgccgttacgccagtggaaaccgtcctcgccgtcggtctccagataacgcgccacatgcggatcaccgtgcaactccatcgcagaggtcatgcgccccaccgtacccacgcggcgatcacttaaggattctgtgccggtcaaccgaatcgcaaccggtctgcactccaaccgggcaccgtccgcccgaacggaaggacatgaccgacacgatggtggtggagctgggcctgcaggccatgacgatcgcggcgaagttgtccgcgccgatcctgctgaccgcgctcgcgatcgggttcgccatctcgctgttccagtcggtgacccagatccaggaggccaccctgtcgttcgtcccgaaggcggtcgcgatcggcgcggtgctgctgttcaccggcaactggatgctgcaccagatgatgacgtacaccacccagctcttcgacaaggttcccgagctgctccgctgaaccgccggcgttaatcgctggaccgcggtgcgaggatgcgggcatgcgcaagattccgacggtgttccagcgtgatcccgaggaccgcagacgggtgctgcccgaagcccaccccgactgcgcctgggtgctggccggcgagggcgtcgccaccaggaaatacgacgggacctgcgtgctcctcgacgaggacggcacctggtgggcccggcgcgaggtccgcccggcccgcacccggccgcccggctaccgcccggtgatgaccgacgagaacaccggccggaccgtcggctgggagccgatcgcccagtcctcctacgccgcctgccacctcgaggcggtcgcccgcggcacgtcctggcggcccggcacgtacgaactgatcggcccgaagatcaacggcaacccggagcgggtgcccggccacgaactcgtcgcccacgccgacgccgaacgcttcgacgttccccgcgacctggccggcctccgcgagtggattctggcccatccccggtacgagggcctggtctggcatcacccggacggccgtcgcgccaaactcaaataccgcgacttcgcctgaccgaccgggcgccgacgcggggtcgcggcgttcggcggacgatgtcgttcccccgggcgtacgtgggcgagcgttcggcgcgggagcgaccctccagccgctggccgtagtaggtgccggcgagcaccagtgcgatgccgagcagggcggccggcgtgagacggtcgccggccagggcgacgccgaacagcaccgcccagaccggctcggtgccgagcagcagactggcgcgggaggcggaggtgcgccggatcgcccacagctgcacgacgaaagcgaagacgctgcagcccagcgccaggtaggtgaccgccgcccactgcgccgggccgtaggcggcgaccgccgcgggcagggcccgggcggccacggtcgagcacacgaccgccccggtcagggtctgcagggcggccagcgtcgcggtgtcgtgcgaccggccccgggtcaggtgggccgacagggtcacgtgcgcggcgcggaccacggcggcggccagcatcagggcgtcgcctgctgacggcgtacgcaggcctggtccggcgaccaggaagaccacgccgagcgtggcagcggccgcgcccccgaagaatgccggcggcagccatcgccgccgggtgaagccctccaggatcggggtcatcaggatggtcaggctgatcaacacgccggcgttggtggcgctggtcatcgacaacccgaaggtttccaggatcagcaccgacgtctgggtgacgccgagcccgacgccgaccaggagctcccggcggtcgaaacggccgcgggaccggcgcaccgccagggccggcagcagcgccaccgccgagatcaggaagcgcagcgccagcagcaccagcacgccgcccgccgcgaccagggtcttcgccgtcaggtagctgctgccccagaccacggcgacggccagcaggagaagatcgcccacgcgagaagtcgacacacggtgagcgtcggcggcggcgatccggtagacaagagggcaacctctgaatcgacgatgtagtggagccttgtggatccgcaccacctgcgactgttgcgtgagctcagggaccggggcagtgtcgccgccgtggcccgtgcgctgcacatcacgccgtccgcggtgtcccagcagctgaacacgctgcagcgctcggcgcgggtgccgctgaccgagcgggccgggcggcggctggtgctcaccgcggccgggcgggccctggccgcggccgcggtcgacgtgctgaccgcgctggaccgggccgaccgggcggtcggcgcccacctcgacgacccgctgtccccggtcaccgtcgcggccttccacagcgccgcgctgacctggttcccggagctgatccggcgggccccgcaggtccgctgcgccgacgaggacgtggcccgcgccgacttccccggtctggccggcgactacgacctggtgatcgcgcaccgggtggcgcacagcccgccgtggccggccgaccgggtgaccgtgctgccgctgatctacgagccgatccatgtggcgatgccggtcggctccccactggccgacaggcagcggctgaccgcggccgacgtcgccggccagccgtggatcagcgtgcacgaggggttcccggtcggcggggtgctcaccgcgatcgccgcggcggccgggcgacccctcgacatcgtgcaccgggtcaacgagttcaccgtcacggcggcgatggtcgcggccggtgccgggctggcgatcatgccggcgctcaccaccgtgccggatccgcgggtggtgctgcggccgctcgccgacctgcccgccgggcggcacatcgacgtgctgacccgcccggagacgctgcaccgggcatcggtccgggccgtgctcggcgcgctgcgcgagatcagccgttccggtggtgcttcttgacgtacgtgtaaccgggccccatcgcgtcctcgtcgatcagttcgttctccaccgcccactggtaggcggccatctgcctctcggacggctgcgccccgggcggaagtttccggatgaaccccttcacccagtgctcgcgccggtcgtggtgctcgtcgtcctcgtcgtcgtcctcgtgcggatgcggcgcgggctccaccagcggggcgtagaacagcaggtccaccgggtcctgtccgtcgaccgcggggtagcaggccagcccgtccgcgtcggtgctgccggtcacccgggtcacgtaaccctcccggatcagctggtccaccgcgtttttcagcaggaacgtgcccttctgcccgcggcccagcccggcctgcccggccagcgagtcctccgggaacaccgcgctgccgtcctcgaacacccggcccagcccgcggatcaccttgagcacctgcccgcggttcgacggccggggatcgaaatcccgggtcaccaccagcgggtcgtattcgtggtagtagttgacgccgtcgatccgcatcgggtcgtcgagcacccgggtccgcaccaccaccgcgtcccgcccggcctgccaggtgacggtcacgaccgtcccggtctggacgtcggccggccatccgatgccgctgaaccgccaggtgggctcgcgctccacggcggtctcgaacacctcacggaccgcggtgatccccttgacccggtgctccagcaccaccatcaccggatcccggccgatcagcgcctcggcgatctcctccgcgaccgggcagaccaacccctccaggtccgctcgccacagcgtcacccgtcgcgtcacggtccgcatgtcccctcccaaaaccccaggccagaagatgctcgcacaccgccgggtccgctgtggccgccggttgtcgacttggtgggttcccgcgcaatggggctcacccatgttctggcggcggaggcgggctcgaccggtccttcgctcctgaccttcatgtccgttctcgccatgatcggcggcctggcgacggtcgtcccgggcgtgaccggtgccgttccctgcgccacctgacccgctcccgttgagcgtgccgggcccgcatggcggggctccgccctttaccgagaaagtctcacggacaggtgccgttcccacccgcgcggcgaggtgagacgggagcggtagggcgcggcggtgcggccctgcggcgagcggagcggcggtcagggggcgtcgaggatgccgtaacgggcgaggatggcggcgcggcgttcctggttgacggtgcggacccggcgggcgatgaagaagacgtcgagcagtgtccacacgcccacgccgccgagggtgaacagcatgacgatcgagcgggcggtgtctccgaggtagaagcggtgaccgccgaagatgccacagacgcaccacagcacgtacgcgataagcggatttttccggactgatgcatattccgcctcggcgcggagaagccgcaagcgctcccactccggaaggggcaccccggaggtgggccgcgggccgggtgggtgggtctccggcaaggatgagcccggagcgggccgcgcgccgggtgggcggatctccgggagggatgagccgtgagtcggccgcggcggtcggctgtccggaaccggatgcgcggcaggcgggaaaccggtgcccggggctctgcccgggggaggctccgtgggttcggagtggggcgcgggcacggtcagggcttccgggcgacggcgccgaagagggaggcgtcgaccggggtggggtgttccgggtcggcggggtcggggcgccagtcgccgatcgccgtgatgccgggcgcgatcgggtcgaggccggcgaaatagtcctcgaacgcggcgcgggtgcgcgggtggacgtcggagcggccggtgcgcagcgactcgtcccagttcgccttcagttccggggtgaggaagtcggtggtggcgctggtcatcgtcaggtagctgccggccgggagggcgtcgacgagggtgtggacgatctcggtggcgcgggcgtggtcggggaggaagtggatgacggcgaccaggatcagcgcgaccggccgggtcaggtcgaggatgtcgagggcggccaggatctcctcgggccggcgcaggtcctgctccaggtagcgggtgcggccttcgggggtgctggtgagcagggctcgggcgtggaccatgaccatcgggtcgttgtcgacgtagacgatccggctgtccggggcgacccgctgggcgacctggtgggtgttgtcggcggtgggcaggccggtgccgatgtccaggaactggcggatgccggcctcgccggccaggtggccgacggcgcggcgcaggaaggcgcggttggcgcgggcggcgatccgggccgcggggtaggaccgggccagcaggtcgccggactcccggtcggcggcgaagttgtccttgccgcccagccagtagttgtagcggcgggccgggtgcggcaccccggtgtcgagcttgtcgatcgtcaccggacggatcctaataggatgacgtatgccctggtagaggcggatgatgatcactcaccgtgttcagttgaccgcctagagtgtggcgatttgtcgcgaggctccggacggggcagtatgcacgggtgcagcgttaccgagttggcatcctggctgtcgcgacggtcgtggtcctcggcggtggcggcctgatctacgcgggcctcgacggcgggtccggcggtggagtcgtgtccagcgccctgagcctggacgggtcggacacctcgaccaagggcgcatccccgtcgccgaccggcccgagccccgaggagctggcccgggccgcgcgggcgcagcaggccaaggcgctgaccgccgcgctgacgaagctttccgcggcctcgccggagttctcggtcgccgtgctggacaagacgaccggtgagtccttcgccttccggggcgacgagcactatgacacggccagcatcgtcaaggcgcagattctcgcctgcatgctgctcaaggaccaggacgccgggcgcgatccgagttcggccgagatggccctggccaagccgatgatccagttcagcgacaacaatgcgaccacctcgctgttcggccggatcggcggcaaggcggcggtcggcagatgcaacaagcgtctcggcctgaccgcgaccgaggtcgcctcgtcctggggtttcacccggaccaccgccaacgaccaggtcaagctgctcgccaagttcgtcgacgtgaagggtccgctggacgcggattcccgcaagaccgcgttcaagctgatgaacaccgtcagcaaggggcagacctggggagtgccgtcgatcgcgcgcagcggcgagacgaccaccgtcaagaacggctgggacacccgctcggccgacggcggcctgtgggcgatcaacacgatcggccgggtcaccgggggccgggtggacgtgtcggtggccgtcctctcgcacaacaaccggtcccagccggccggtcaggccctggtggagaaggtcgccaagctgacccggcagtatctgaagtactgatcagccggcggccgggccgctccgtcgtcgccccgtcgtggccggtgccccgccgctgccggtggcccgcgggacgggtcgagtccggaaaccgatggccgggtgcgcaccgggcgtgtcaggctgccggcgtgaccgaacgcgagccgatcgtgatgcaggtgtactgccgggtgaaggtcgtcgtcgacgacccggccgcgatgaccgaggtggccgtccgccggctgcgcgaggccgacatcgactggtccgccgaggccgacaccctcgccgaggcggaggcggagatgcgcaccgacctgccgcaggccctctcctcgctggtggacccggcggcgctgctcgccggcgtgcccggcgtcgagatcagcggcggccggtggtgggcggagcccggcgagcccgcgcccggcttccagccgggcttccccgggccggcccctcgtcgcaccgtctgaaccggacagtgacgcattggtgatcttctgtttgactgggtcgcatgcagagcgcgccgcgactggcgatcgactacggttccgcgtgcacccgcgcggtgctggcctggcccgaccgcccctggcagccgctgctcgtcgagggcaccgcggagccgtccagcgcggtccacgtcggtgcggacggcgccctcaccgcgggcgccgcggcctggcggctcgccgccgacgacccggccggtttcgtggagtcgccgctggccgccggggtcgggacggtccgggtccgcggccgcaacgtggagatcgccggcctcgtcgccgccaccctgcgcctgatcgcggccgaggcggtgcggatggccggcgtgctgcccgccgacgtccggatgagcgttcccgccggctgggacccggcccgccgcacctggctgcggcaggccgcccaccaggccgggctcaaccgtccgcagctcgtcgaggcgccggtcgcggcgctggtcgccacccgctgcaccgcacggccgatccccgttctggatccgccgtccgccgccggaccgccgtcgtcccggccgtccggcggcggtacgacgtatgccgccacgaccgcccccagccggttcgtgctggtctgcgatgtcggcgcgaccgccgaggtcagcgtgctgcgcgccgacctgtccggcgccgaggtgatgtccacggtgaccggcgtcgacgccggtggccgcgccatcgacgaccgcctcgtcagcatgctcctgcaccgcgaagccaccgccgcacccacccgcccgtcgcccgccacgaccccggtcggatccaccacgacccgccgggtccccgacctggacacgacccgccgggtccccgacctggacacgacccgccgggtccccgacctggacacgacccgccgggtccccgacccggacaccaccggccgagccgccgtcggccaccgtcgccacggtgtccccggtcgccgggtcgagcacgtcgaaccggttccccgaggacgcgggcacccatgtgccgccgatgaacagttcggtttccacaacagctcctcttgccaaggtccggttacgcccccagcattccccgcatccggtcgtgccgccacgcttccgggattggccccctccggagcgggccggggcggttagcgtgagcagcgtgaccgtgggatttctcgggctcggcgtgatgggccggccgatggcgctcaacctggtccgggccgggaccgacctggtggtctggaacaggtccgccgcggcgcgcgacgagctgcgggcggccggggcggcggtggcctccggggtcaccgacctgttcgcccgggccgatgtggtgctgatgatgctggccgacgaccgggtcgccgacgaggtgctgggccgggacggcccgggcttcgcgggcatgctggccgggcgcaccctggtgcacatgggcacgaccgcgccggcctggtcgcgcggactggccgagcaggtggccgacgcgggcgggcactacgtggaggcgccggtctccggctcccgggtgccggccgagaacgccgagctggtcgcgatgctggccggggccggcgccgacctggaccgggtgacgccggtgctgggcccgatggtccgggagacggtccgctgcggcccggtgccgaacggtctgctgatgaagctgtcggtgaacacgttcctgatcagcatggtgaccggcctggccgaggcgttccacttcgccgagcggcaccggctggaccgggccaccctgctcgccgcgctggacgccggcccgatggccagcccggtctcccggctcaagggccgcaagctgctcgacggcgatttcgcggtgcaggcctcgatccgcgacgtcctctacaacaaccacctgatcgtcgaggccgccgagacggccgggatcccgtccccgctgctggacacctgcctggagctgtacgcggagaccgcctcggccgggcacggcgccgaggacatggccgccgtcatccaggccctgcgggcccgctgaccatccgggcggcgatcgcggccagggccggcggctccagccggtcgggcagcgagccgaggtcgtccgggtggatccaggcgtgtcccagcaggtcggcctgctcataggggagcaggccggcgcgggagaccgccggggaggcgtccggatagaaggcggcgaagaactgttccgcgccgacgaagcggcggcctttccacaccgtgtcgcggtcgacgtcgacgtgctccggcaggatccggtccgggtcgaggccggtctcctcggtgagctcgcgacgggccgtctccaggggtgtctcgccggggtcgatgccgccaccggggggctcccagaggcgtaccccggaaaggggatcctgccagtgcatcagcaggatccggccgtcggcgtcgaagcagagcacccggacggccgggcggtgggcgacctccatgaccacaagcctaagctgagccgagtggcgaagtacttcgacgtgcacccggacaacccgcaggcgcgcagcatccagcagatcgtcgagctgatcggtgcggacgggctgatcgcctatccgaccgactcgtgtttcgcgctgggctgccggatgggcaacaaggacgggctggaccggatccgggcgatccggcacctggacgacaagcaccacttcaccctgatgtgtcacgacttcgcgcagctcgggcagttcgtgcagatcaacaatgcgctgttccgggcgatcaaggcgagcaccccggggccgtacacgttcatcctgccggccaccaaggaggtgccccggcggctgctgcacccgaagaagaagaccgtgggggtacggatcaccgggcacaccaccgcgcaggcgatcctggcggcgctgggtgagccgctcgtctccagcacgctgctgctgcccggcgagccggagccgatgacccagggctgggagatcaaggaggcgctcgaccacgcggtggacgcggtgatcgactccggggagtgcggcaccgagccgaccacggtgatcgacctgtccgagggggtgcccgaggtgctccgggtgggcgccggcgatcccggccggttcagcgggtgacgggcgagagcgcggtcagcggcaccgcgccggccagcgccagcatgccggcgtcgttcgggtgcaggtggtcgccggagtcgtaggcggccgccagccgttccgggtcggcgccgtcgcggaccgccgcgtcgaaatcggccaccgcgtcgaactcgccgccctcccggatccaccggttgagcgtcagccgggcgctgcggtgtgccggctcgtcgtacatgctgccgccgaacggcagcagcgtgccgccgaccaccgagagcccggccgcccgggaccgccgcaggagcgcccggtgcccggcgatcagcgcctccgcggtcgccccgccggagccgatgtcgttcaccccgatcagcgtgatcacgtgcgacaccccgggctggtccagcacgtccgggtcgaaccggcgcagcccggccgggccgtactgccggcggacggtgggcggcgtggcctgggccagggcgccgaccggtgccgcgccgcgtacctcggcgccggtgagcaggcggttgccgccgatcccggcgttgagcacgccgagcggcagtccggcggcccggacccgggcggccagcaggtcgggccaccgccggtcggcgtccagcgtcgtctgcgtcccgcaggtgatcgagtcgccgaaggcgaccaccgcggagctcggtccggcggtacgcacgctgaccccgccgagcagcacgtagcgggtgatcacagcgccggcgggcggggccggcgcggcggcgacgttgcccgtcaacacccggccgtgctggaaggagtgcgggctgagggtgccggtccgggtccgttcgggcaggtgaaagctgatcaccaggtcggcgccgggcgccagcggcaggtccggcaccgggtcgctgaccaggtcaccccaggccggcagccggccctcggtgcggccgtcgaaggtgaccgggcggatcgtgcccggccacatcgcggtgctgtccgggtcgccggcacgcaccccgatccagacctcgccgaaccggatccgttccgggccgtaccggttggtcaggtgcacccgcggcgcggcgccgcccaggctcaggtgcacgacctggcgcacggtgcagtccgcgggcagcggtgcggtgtccggtgtcgcctcggtcggcccggtgctccaggtcccggtccagggcgcggcgacgcgggcggcgtacttcggcccggcgttgccgggcacggcgatcagcacggtgacgccggcgccaccgaagatcagggcgcgccgagagacggcgcgccctgatccgcgggtggaacctggtggcaggatagtcagaaggtaggaaatcgtgcgggtggcgtcaagagccggaagtgcaggtcaggttcggtacggtggccggcgcgctgcccgagccgaggaacccgaacgtggtgtggtcgccggccgcgatcgtgccgttccacgtctcgttggtcaccgacaccaacgatccggtgctggtcgccctaccgctccagagcgaggccagcgtctgaccgccgggccaggtccaggagacgtgccagccgttcaccgcggtggtgccggcgtgcaccatcacctgcgcctggaacccaccggtccaggacgaggtgacgttgtacatcgccgagcacccgctgccggtgccgccgcccggggtggacggcgacgcgctgggtgaggacggcggcggtgagctcggcggggtgccgattccggtcacctgcccgttgccgccgtcgaacaccacgtcggagcagccgtagaaggtctccgtgctgtccgagcgggaccagaccgagtagatcaggtgcttgccgctcttgccggacggcagcttcccggtccagtagtagtgtccggcgtcggtgcccggcccgccgtcggccggcgggttggtcaccgtgtcgaacggggtcggctccaggtcgctccaggcgagcggcctggtcgggtcgtacccgtccttggtgatgtagagcgagaaggtgccggggtgcttggcccagtcgttgtagtggaactccatggtggcgccggccgtcaggtgggtcgtcggccagtcgtcgcgggccaggttgtaaccggtgaagtcgtacggtccaccggtcccgccgctgcacagctggccgtccgggatgaacccggagacccgcccggccccgtccgagcggagcacggcgaaccagttgtacagcgacgtcaccccgctcttggcgaccgccgcggcacaggccgggttcttcggctcgatcgcgccggtggtcgggttgcggccgtcctggtagcagaaccaggtgcggctgccgggcacttggatggccccgtgcgcctcggccgtggccgggacgaagagggccccggccgcggcagccaggacggctgccgcgaccagacgggcgagtttcatgcgtgtcacccctccgggaagagtcgggcgtagtcggcgtagccggtggcgacgtcgacctgggcccagaaccggtggtagttgaaggtgggtgcggcaccgccgttcaggtacgcctggaccttcgggaagtccgggtccttcttgtagaaggagcggatgtcgaggaacgacacccccggcttgatcacgtcgccgttgggcatcctgccggtccagccgttcgggatgtagatgccctggcccgtggtggcgtcgtaggtgtcgtccatccgcttgtagtcctcacgcgtctcggtgaccgagacacccttggtgtccttgtgcgtccagatcgcgtcgagcaggttcttcgccgcggtcttggccgccgtgttgccggacttggcggcgtagtaggcgagcagcttggcgaacgagccggccacccccaggtcggtgcccctgctcttcaccgtgacgtgcaggttcgtgttggcggccgggctggccgcgttccacgtcgccggagcgcccgaccagcccaggtcggacgggatggcgaagctgcccgcggtgatgtcggaattggcgagggcccaggtcacccacttgtcgaggatggtcttggccgtggcgtcaccggtcgtgtagtagtactcggcgagccgctccagcgaccaggtctgcatcccgaaccactggttggacggcgggtcgccgtacaccggcgcctccacgtacgacatcccgtagaaggtcggcgtgccggccggcggcgccgagtagctgccgtcccagctgttcgtggcaccaccggcgatggcgccctcgctggactgcagccaccggtagaactccagctgccggctcaggctggcctgccagtcggccttgccggtgggcgacttcgggttgagtgcggcgacgctggacaacgcgtacgccgccatcgggttctgatagccgaagtgactggtgctcgatccgatccgccaggcccacccagcgctggtgtcgtacgcgccgccccaggcgtagtaccaggacagcaggttgctggagctgttcttgccggtgccggccgggcacgcggtggacgtgcagccgggctgcttgaagtacttgtcgtagaacgcgtaccgcaggtagtcgcccatcttggcggcgttggccacggtgccggagatctgcgactgcttgccctgcgcggtggcccaccggttggcccagtaggcgacctggatcgaccgtgcgtcggcgtccggcgcgttggtgtacttccactgcctggcgtacgacgtgtccttggtgaacaggtccaggtagccgttcggaccgccgaacttgaacgtgtcacacgacggctgcggcaccgtctcgaacgtcgactcctgcgggccgcgctggaaggtgttgatgtacgcgacccgggtggtgccgtccccgcagtgcccgaagccgtagacgttgtccacgtccatcagccagtgcgtgccgtagatgtcgtcggtgttgtacgtgctcttcagctcggcggccagcgggtcggaacccaccgagacgctgctgtccaactgtgacgggtactgcgacggcagcgggtgctcggccgcgtaggtggccggcttggacgcgttgtagttggcgttggtcggctggtcggcgtgcgacgggatgatgtacttctccatcgtcgaccaggcactgttgaacggcgcccagtccccggtcacctggccgtgctcggcctccagccacagccagtagctgaacgcctcgctggtcgtctcgtgcccctggtcgggcgcctcgtcgatcagcgtctcgatcgagtggtacggcacgccctccgggctgaagtagccgttcgacgggttcttgatgtcgttgtacatctgggtgaaccggacgtcggtcgacccggccgcgaccacgctgaccgccacggtcgccgccgtgtacccggtggcggtggccgagatggtggcggtcgacccggcggtcgccgaggtgctggccgcgaccgtcaccggctggccggtccgccagttctgcggggtgaaggtgagcgtggccggggtggcggtgaccgcggtggtgccggccgaccgggccaccgtgaccgtcacgtcggcggtcggcgccgcgctcagcgccaggttgaacgtcccgctccggcccggctccagggtggccgaggtggcgtcggcgacgatcgacggggtggtcgacgcgtcgacgaagaccggtacgtcggcggtgctgctcctggtgccggccccgtcgtacgccaccgcctgcaggtggtaggcagcggcctgggccgggacaccgctccaggtgtacgtgtacggcgccgtgtcgtcgctgcccagcagcagcccgtcgtggtagaactcgaccttggcgatggtctgcccgccggccgcggtcgcggtggccgcgatcgggatggccgccggcccggtgtaccgggtgttcgcggcggggctgctgatcgccaccgtcggcgcggcggccgagccgttgcagggctgcccgttgagggtgaacgaggtcggcaccgggttggtcgagccgaacgtgccgttgaacccggtgccggtggtggcgccggtgcccagcgtgccgttccaggacgcgctggtgatcgtgacgtgtctgccactctgcgcgtatgtgccgttccagccctgggtgaccttctgggcggcgtccgggaagtcgtactccaacttccaggaggtgagcgggtcgccggagttggtgatggcgatgtcgccggtgaacccgccgggccactggctgggcaccttgtagacgacggcgcagccggccgcggcgtaggcgggtgggccgccggccgcgaaggccgcgccggcgccgagaacggcgacgccgaggacggcgagcctgcgtcgcaggcggtgtgcggactgtctcacgggaagtcctcctaggggacgcgggagcaggaaacgggagacgggacggggtcggtggtgccggtggtgctgccgaggaatccgaaggtcgtggaagccccggacgcgagggcgccgttgtaggacgcgttggtgacggtgaccgcggagccggactgcgcggcggtgccgccccagctctgcgtgacggcctgtccagccgtataggcccacttgacggtccagccggtggtggcggacgcgccggtgttggccaccgtgacttcgccttgaaaaccgccggaccaagagccgattgttttgtacgaggcggagcacccggccgtgggccgacggggactggtcgacggggatgcgctcgggctcggcgacgcgggtgcggagggcgttgcaccggtccggtcggcgtagaggatgccccggccgttggtgccgaggtagacccggccgtagatgcgggggtcgccggccagggcgtcgccggcgttgccgtaccggtgcccgtcgtcgttgatccgcacccaggaggccccggtgtcgtcggagcggtacaccccgtccaccccgtcgaccgtgccgaccaggaagaccgccgggtggctcgcgcccggcgcggccttgccgaaggccacgttcacgcccgcggtcacctccgccgacacctgggtgaaggtcttgccggagtcggtcgagcggagcagcccggtgctgccggccacccacacctcgccggccacgcccggcaccgccttcacgtgcagccgcccggcgctgggcagcgccacggtcgacgcggtgaagctggcgcccccgtcgacgctggtgtagaagctgccgccggcgtacgcgtagaaggtctcggggttgacccggtccgactcgacgatcgccccggccgggacgccggtggacgccgtccagctgctgccgcgcgtggtcgagtagtggaccccggtgccggccggcgaccagaccaccgcgttcgcgtcggcgccgactgcgacggtgccgccgccggacaccccggccggctcctgcccctggtaccaggtcttgccgccgtcgttggagacgccgatgtgcggtgccgcgtcggcgttgcccacccggacgaagaacgacgggctgagctcggcgaagtcgaggctggtgttgctgcccaggctcggggtgtcgtggaagctcgccggcacggtgtccaggtcggcgtggtagaaaccgcccacgtcaccgagcgcgctgaccagcggggcgccgctgggcgggctggccaggtcgaggaccgcggtctcctcgatgcccttggcgaccggcttgatggtgatggtgccgccggagtcccacttggtcaggtcggtggtcccgtacagggtggcgccggtgccgtagagcagccggttcgagtcgaacgggtcgatctgcagcgactcgttcatccagccgagcttcgggctctcctccggggcggccggggcgttgttgaagtccagccacgggtcggccgagatgtccagggcgtagcgccgggagcggctggggtagccggtccagtcccaggcccgggtccaggtggcgccgttgtcggtgctgcggaagaagatcgcgtccggccaccaggagatctgggtggcgaccatcagggtgcccgggtgctgggtgtcgacggtcagcccggagtagccgtagtaccggtcggcgaccgcggtcggcgagatgtcggtccaggtggcggtgctgatccggtatttccagaccgcgccggcgccaccgtcgtacggcccgccggtatcgctggtcgcgatgtacaggtagtcgccctgaaccacgcccttgtgcgcgaggtatccggtgggctgcccggcgatccgcgaccaggtgacgccgctgtccgcggacatgtagaccgggttggcccggtccgcgacccccacgaagacctgcccggcggccccgaaggtcacccaggtcagcccctggttctgggcgaggtagccgctggtgtcggcggggtcctgcacgtagttgccggcgttcgggaaggcggtcaccctggcccaggtcacgccgtggtcggtgctgcgccacagcccgttgcccccctcggcggcgaagtacacgttccggttgtcgtgcgggtcgacggccagccgctcccccatgccgcgaccgggcatgttgccgccgaccttgaacggcagatcggtctgctgccaggtggcgccccggtcggtggagcgcaggatcgcgccgttgttcgggtcccagctgttggtgtacatgccgaccgcggcgtagacccggccggtgtcgaccggatcggcggcgatgctcagcacgccgttgtggccccagtcggtctggccgaccccgtccagcagaggggtccagctctggccggtctggttccagcggtaggcgccgccgatgtcggtgcgggcgtagatcaggttcttctcgccggggttgaagacgatgccggggatgaaaccaccgccgtcgatccggacgttcttccaggtgtaggggtcggccgcggcagccgtggcggagggcggctgggcgacgacgaccaccgaggtggcggcgaccaccagggcggcgaccagcgcgccgccgggggaccatctcatgggggagcccttccattgacgtacataaacctgggagcgctcccaaagcgtcggcctccgtcatcgccgtgtcaagagtcggaaacatgcgtccgacgtcgccgctcgactacacagcgcgacatccggcggcggatccggcgcgcgaccagattcgatcccggggcaccggggtagatggcctggtcagcgccggtgtgcccgagtgaagtgcggtgagcagcgacaagttgcgggaggggcggatgtgtatcattcggcgggacacgcgggccggcgcctgtcgggcggcccggcgaacagccggcgggcagaggaaccggtacacggcgtgacgacggcccggcgtagcggtggaggagattgcatgaaggtttgcgttgtgggtaccggctatgtcggtctgaccaccggcgtcagcctcgccttcctggggcacgaggtgacgtgcgtggatctcgaccagaacaaggtcgacatgctgcgtgccggcaagtgcccgatctacgagcccgggatggaggagctgctcgccgaggcggcacccaacctcagcttcaccaccagctacgacgagggcgtgcccggcgccgacgtggtgttcgtggcggtacagaccccgtcggccgcggacggcagccccgacctgcggtacctccgctccgccgcggagagcgtggcccgctcgctgaaccacgacttcaccgtcgtggtgaacaagtcgaccgtgccgatcggcagcggcaactgggtggacgcgatcctgcgcgagtcgttcgcgcagcgtgacgaccgcccggccggcgtcgagttcgcggtcgcctcgaacccggagttcctgcgcgagggcaacgcgatcgccgacaccctgttcccggaccggatcgtgatcggctcggacaacccgcgcagcctggaagtgctcaaccggctgtaccggccgatcatcaaccagaccttcaccgcgccggccttccagccccggccggaggatgccagcgcggtcccgctggtctccaccgatctggcctcggccgagctgatcaagtacgcggcgaacgcgttcctggccctcaagatcagctacgtgaacgagatcggccagctcgccgcgaaggtcggcgccgacatcaccgaggtcgcccgcggcatgggcctggaccagcggatcggctcccggttcctgcagcccggcgtcggctggggcggctcctgcttcggcaaggacaccaaggccctggtcgccaccgccagcgagtacaacctcgagatgccgatcgtcaccgcggcccgcgacgtcaaccagcggcagcgcgcgatcgccgtcgagcgcctgcagaacgagctgcgcatcctcaagggccgcaagatcggcctgctcggctgcgcgttcaagccgaacaccgacgacctgcgcgactcccccgcgctggacatcgccaacctgctgctggcccggggcgcccgggtgcggctgcacgacccgatcgccggcgagcggttccgccgcgagcagcccgagctcgcgccgtacctgagcgagaccctggacggcgtcttcgacgactgcgacgcggtcgtgctggtcaccgagtgggcgcagtacctggagctggactggggcaagttcgtcggcctgatgcgcaacccgctggtgctggacgggcggcacgcgctggacgccgagcggatgcgccggctgggcttcaagtacgttgcggtggccggctgaccgcggccccccgtttccccgaaccgccgaggcgatcttcgcctcggcggttccttttgttcgatccgtccggccttctcccgggaagcgcaacaaaaccgactcaccgctcgtatgatgaccgataaacccctacatataagggtataacccccgccagaactggcgtcttcccactatcttcttaaccggttaaggtgccgggccgtcgcagctatatcgttaccgactcgatcacgcggaaatcattgcgcaacgtggcggttacctcttgactgttggtcaagaagcgcttcggacggcggcgtcgccagacgccggaggcgctcaagacatagggagcggtatgttcggtcacagtgggagttcgcgatcccgagtcgcgctcgccggtgccctcagcgccgggctgatcttcagcctggccgcgtgcggcaacgacaagaagagcgactcgaccggttcgaacgatgcggcctcggcgggcatcgactgttcggtgttcagccagttcggcgacatcaagggcaagacggtgtcggtctacacgggcatcgtcacgccggaggacaccccgcacaagaagtcgtacgagcctttcgagaagtgcaccggcgccacggtcaagtacgagggcgacaagtccttcgagacccagatcctggtccgggccaaggccggcaccccgccggacatcgcgtacgtgccgcagccgggtctgctgcagcagctcgtcgccaccggcaaggccgtcgaggccccggccgaggtgtcggcgaacgtcgacaagttctggaccaaggactggaaggcgtacggcacggtcgacggcaagttctacgccgcgccgctgggcgccaacgtgaagtccctcgtgtggtactcccccaagcagttcaaggagaagggctacacggtccccaccacgctggacgagctgaaggcgctgagcgacaagatcgccgcgaccggcagcaagccgtggtgcgcgggcatcggctccggtgacgccaccggctggccgctgaccgactgggtcgaggacttcatgctgcggatcaacggcgtggacacctacgacaagtgggtcaagcacgagatcccgttcaacagccccgaggacatcgcggcgtgggacgcggtcggcgcctacctgaagaacgacaagtacgtcaacggcggtctcggcgacgtcaagagcatcgcgtccaccacgttccaggacgcgggtctgcagatcctcgagggcacctgctcgctgcaccgccaggcctcgttctacgcggccaacttcgccaagggcaccgacatctcggagaacggcgacatctacgccttctacctgcccggcaaggacgcggccaccaagccggtcctgggtggcggtgagttcgtggtcgccttcaacaaccggcccgaggtcaaggcgttccagtacttcctgtccaccgacacctgggccaacctcaaggccaaggtgtcgagcggctgggtgagcgccaacaacggtctgaagatcgagagcctgaccaacccgatcgaccagctctccgcgaagatcctgcaggacccgaaggcgcagttccggttcgacggttccgacatgatgcccgccgcggtcggctcgaacgcgttctggaagcaggccacggcctggatcatcggccaggacacgcagaccacggtcaacaacatcgaagccgcatggcccaagaagtgatctgagttctactccgaggccggccgggatgctcccagcatcccggccggccatcgccctctttcccctcggaatcacgaaggaggtccgggtcgcgtgtttcacaccgcaaacgacacccctgaaaagcttcttcagatgctctccgcgctgctgctgttcgccgcagtgctgggcgtcattctgttcctggcgagccgggttcggggcaagcgctccgacaactgggtcggctacctctacctgctgccggtcgtgctgctgctggccgtcggcctggtctaccccggcctgcgcaccgtctacgagtcgttcttcgatgccagcggcggctcgtacatcggcctcgacaactacaagacgatcttcaccgacgacgacctgctccaggtgctgttcaacacgatcctctggacggtgctggtcccgctggtggccaccgccatcggtctgatctacgccatcctggtggacaagtcgcggttcgagtcgttcgccaaggctctgatcttcctgcccatggcgatctcgatggtcgcggccggcgtcatctggaagttcatgtacgagtaccgggtcgaccagccgaacgtgaagcagatcggcctgatcaaccagctcatcgtctggctcggcggccacccgctgcagctgctgatctccgacaacctgccgggtccgctcgggatgaacaccctgctgctgatcgtggtgttcatctggatccaggccggcttcgccatgacgatcctgtccgcggcgatcaaggccatcccggacgagatcatcgaggccgcccgtctcgacggcgtcaccccgtggagcatgttcgtcaagatcacgctgccgagtgtccggaccaccatcgtggtggtgctgaccacgctggccatcggcgcgctcaaggtcttcgacgtggtccgcacgatgaccggcggcaacttcaagaccagcgtcatcgcgaacgagttctacagccagctggtccgggccagcaaccaggggctcgccgccgcgctcgccgtggtgctgttcctcctggtcaccccgatcatcatctacaacattcgccaagtccgtcaggaggcatgatgacggtcaccccgctgacgaccacaccggacatcactccggtacagctgagcgccgccgctgtcgccaagaagaagctcagctcgccgtgggcctccctggccgcgatcgtgatcgcggtgctctggacgattccgaccttcgggctgctggtctcgtcgttccggcccgagctggcgatcaagcggaccggctggtggacgttcttcagtgacccgcaggtcacgctggacaactaccgcgcggtcttcgacagcgactccgggatctcgctcggcacgtatttcatcaactcgctgatgatctgcatcccctcggtgctgatcccgctgtcgctggcggccctcgcggcgtacgcgttcgcctggatcaacttccgcggcaagaacatcctgttcgtggcggtcttcgcccttcagatcgtcccgctgcaggtcaccctgatcccgctgctgaccatcttcggcaaggtcgggatcgccggcacgttctggccgctgtggctggcgcacaccacgttcgccctgccgctggcgatctacctgctgcacaacttcatcaaggagatcccggcgaccctcatcgaggcggcccgggtggacggcgcgggccacgtgtcgatcttcttcaaggtgatgttgccgctgctcaccccggccctggccgctttcggcatcttccagttcctctgggtctggaacgacctgctggtcgccctggtcttcgccggcggcggcgacacggtcgccccgatcaccctgcagctggccaacatcaccggcacccggggcacggcctggcacctgctggcgtccggcacgttcgtctcgatcatcgtgccggtcacggtgttcctgctgctccagcggttcttcgtgcgcggcctgctcgccggcagcgtcaagggctgaccgccgcatcggaaggggccgcaccgtccggtgcggccccttttccggtgccgctcccggcgcggtcaggccgcgccggcctccaggcggccgtcgcgcagggtcaggacgcggtcggcgcggtccatcaggctcgggtcgtgggtggcgaccagcgcggtcatcccgcgcgcgtcgaccaccgcgcgcagcaggtccatgatggcccgcccggtgtccgagtccagctgcccggtcggctcgtcggcgatcagcagatccggatcgttggccagagcccgggccagcgccacccgctgctgctgcccgccggagagctcgccgggccgctggttcgcctgcccgcccagcccgaccagttcgagcagcaccgacacccgctcgtcgcggtcccgcggatcgcgacgagcgagccgcatcggcacgctcacgttctccgccgcggacaggatcggcaccagaccgaacgactggaagacgaagccgatccggtcacgccgcagctccagcaactccctctcgccggccccggtgacctcccggccggccaccacgatccgcccggcggtcggctggtccagcccgccgatcaggttgagcagcgtggtcttccccgctccggaccggccccggacggcgaccagctcacccttctcggcggtgaacgacaccccggcgagggcgtgcacgacgcggtccccgctgccgaagtcacgaccgaccccggtcacctcgacgacgctcatgccggctccccctgctccgccgcggttcccgggcgcacctcgacgtggtccggttccagattgaggcgtacccggtcgcgcagctcgagcgcctccacgaacgcggccggcaactgcaggcgcccggcccggtcgagaaccgcgtactcctcgctgacgtggtgttcgcttccgtccgcggcgagtcgtgcggaacgacgtacctccgaagccgtcttgccgtcgcggatcgcgaccgcccggcggacctggccggccacgttccggtcgtgggtgaccaccacgacggtcaccccgagctcggcgttgaccgtgcgcagcgcgccgaacacctcgtcggcggtggcctcgtcgagttccccggtgggctcgtcggcgaacagcacctccgggtcgttggccagcgccaccgcgaccgcgcaccgctgctgctcgccgccgctcatctcggccggccggcggcccgcctgatcggccaccccgaccatctccagcagctcctcggcccgtttccggcgccgtctgccggccagccgcatcggcagctcgacgttctcccgggcggtcaggtagggcagcaggttgcgcgcggtctgctgccagacgaacccgacgatcttccgccgatattccaggcgccgtttcgcggtcatcccgagcagatcgaatccggccaccgtggcgatcccggcggtcggctcgtccagcccggacaggatgttgagcatggtcgacttgccggagccggacgcaccgaccaccgccagcaactccccgcggtcgatcaccaggtcgaggccctgcagggccatcacctcgacaccctcggtgcggaagatccggaccaggccgtcgcagacgatgtgcccgcgcagccggtcctgccctccggcgcgggccaccgcggcggccgccgcccgcctctccagatcggccagatcggtcgtcacgactgctcctctccgagccgcagcaccgagcccacgcggagcctgcggttcgcgacgttctccacggcgagcgccgcgatcaccgcgaccaccgcgagggccaggaccccaccggcgaaccacggatcgagactgatgccggcggtcaccccggcggtgaaaccgtcgaggccgagcgccggcccgatcagcgccggcagggtgaacccggccaggccgccggccagcaccgcgaccgcgaccagcgggaccagctcgaagaccagcagccggcggccctgccgccgggacaggcccatggtgcgcagccgggacagcgtgcggccgcgggccggagcgccggtcagcacggccagcgcgaccgcggtcagcgacagggccgccgccgcgaccatcccggcggtgaaggtgaagctcagcgcgccgtcgacgccgcgttgctccagcgatcggcggtacgccgtgcgggtggtcaccgtggccgggaccgcgagctcccaggcctgcacggcccgtccggtcaccttcctcagctggtcgacctggcccgcgtcggcggtgtcgcgcagtctcgccacatccaggccggcgccgtcgaccagcagccggttcggcacgatcggcgcgaagtccgggatcggcatggcctgctcgggcagcaccatgaagtcctgtgtgtcggtgccgagcccgggcacggtggcgacgatcgcggcgacggcgtaccggtaccgccggccctgcacgtcgaccgagccggccgtgccgatccgctcggccaggtgcggcgagacggcgaccgggatcgcagccgtgcccggtttcgcggcgaccagcgcggcgggcaggtcgagcccggcggcggccgcgtcgaccaccatcgcctgcccctgcaggatcatcgggctggtgtcgccgtggatcgtggtgccgggggcgagcagcaccggggtgacccgggtgacgtgcggcagcgcggccagccgggcagccgtgtccggggtgaacgcgaacccggtgaccagcgcgtcggccggcacggacaggtccgcggcccggtcccgggcgccgccgaccgtgctggtcacggtgccggtgaacaggccggtggcgatcgccacgaccagcacggcgagcggtccggagtgcatcggggcccggccggcgccgctgagcccgaggaacgcgatcgcgccgcgggcccgggccgcgatccgtccggcccagcgcagcgggaacggcaccaggcgcagcgccaccaccgaggcggccagggcgagcagcaccggggtgccgatcaggtacgggtccacaccggccccggcgtcgagtccgcgccggcgcagcagcaggatgccgccgaccgcgagcagcaccaggaacccctcggcggtgagccggcgggtcggcgggcgcagcgccgccacgtcaccgcggtgcccggagaacgacgggcgccgcgcgtcgaacgccgcgtaggccggggcggccagcaggccgaccaggagcaccgccacgaccaggtacggctcggccgggtcgggccggccgctcaccagggcgccgccgagccagccgagcgccaccgcggccggcaccaccaccagggtctccaggacggtccgcccggccaccgtgtgcaccgccccgccacgcgcccggatcagcgcgaactcggcccgccgccggcccgccatcagccgggcggcgagcaggatcagcccggccgcggtggccaggatcccggcctgcaccacggcgagcagcgcccgcaccgcccgcacctgccggtcgaacgcggccagcgtgctgtccaggctgctctgcagggtggtctcgggcggcgggttgtgccgcagccgggcgaccgccgaggcgagcgcgtccacccggtcggcggtgatccgccgctcgtcgagccggaaccgccaccggtcgccgaagtcgccgacgagattgccggcctcggccgccgcggtctggtcgccgagcagtacggcgagactccgggtgccgtcgcgcgggtcggggcaggccacgttcggcaccagcttcagatcgtcccagatcgggtcggccggatcgttcgcccggtacagcccgacgacctggaccctgccggtgccccagcgcgaggtcaggtcgagccggtcacccagcctgatccggagagcctgcgcctcgtgctcaccgagcatcacctcggggatccgggtggtgtccggttggcggccggcgaccatcgtgatcgccgcggcggcggccggctcgtagcggatcgtcgccgcgttcgggcaggagccggccgtcgtcccggccggcaccacggacgcccggccactctccgcgatgtaccacgacccgccgatcatgccggtcagcggcgcgggcagcttctgccgcagcgcggccagctcgccggcgccggccgccctactcggctcgtagtccctctgaatcgcggacagggtcagatcgcggctggtgtacgccagcctgccgatgtcgccgcgcaggccgtcgtcggtgcgcccgttggcgagccggaccgggccggccaccaggaaggcggtcagcccggccagcaccgccagcaggagcagctgcccggcgaaggcgcggacgcgccgcagcacactcatcggtcctcccccagccgcagccgggccgccggaagccggcgggtggccgaggtcgcggtgatcgcgctgaccgccagggcgatcaccaccagcagcgcggcgctgccggccgtgcgtccccagaggacccgcagcagcgcgtccggcaccggccgggcggccgccggggtgagcaccatctgcggcaccatcccggccgccaccagcaggccgaccgccaggccggcgaccgcgccgagcccggccagcaacgcctgctcgacgatcagcgagcgggccagcaggcgcgggccggcgcccagggtgtgcagcacggccagctccaccgagcggtgccgggcggtggcccgggcgtcggcggcgatgccggccaccgccagcaccatcgcgccgagcgcggcgccgaacagcgcgacccggccggcggtgtcgaacggatcctcgccggaggcgagctcctgccggtcgagcacgcggagcccggtcagtccggtgagcccggcaggccgcccgctgatccaccactcgccggtgtcacggacgatcccgtagccctggaacagccgcgagtcgacgacgccccggtcgatcaggatcgcggccggtacggtggtgcccggcacccggttgaccgtggcgaccaccgtgaccggcaccgacacgccaccgatctgcaggtgggagacgtcgcccagggcggatgcggccggccgggtgatcgcgatcggcaccggagtccacgggccggacgagcggaccacggcatacccgccgaccgcctgcggggtcagcggcgaccagacgtcgtcctggccggtgatgtcccaggtgatcggcacctgccccgaggactccacccggaagccgagcagcccgggcccaccgtccctgatccgcagcggccggtcggcgtcgctggtgcccagctcgacccggcgccccccggcgaagatcgcggtgacccgggccggcccggaggtggtgatccggccggccttcagggtcgcggtcgccgcggtgccggtgcgggcggccgcggccagctcggccagcagatcggcgggcgcgccaccggtcgcgtccgcgcgggcccggaccaccccaccggcggtcgcggtgtccatcgcgaccaggtcggccggctccctgccggcggccacctgcaccgagtcgcgccaggccggaacgacggcgcgcaccccgggcagcgcggcgagctgccggtcccgaccggccggggcgaccccgccggtctcgaccagccgcaggtcggcgccgaccagctgctccgcctgatcggcccgggactgctgcgcggtcgcggccagacaccaggagacggtggcggcggccaccgcgagcgcgagcatcaccatcggaccggcgtgcgagcggcgcccggcctgccaggcgccgagcagcgaagcctgcgagcggccccggcccaggcgggccgcgacggacctggcgaccggcggcagcagccggatggccagcaccgcgccggtcagcacgcccagtgtgggcgccgcggccagcagcgggtcgatgcccaggccgcccgccccggtcggcgccgaatactgccgcagctgcagccaggccagcgcggccagggcgacgacgaccaggtccaggccggcgcggcggagcaccggcaggcgtttgcgcccggcggtctcggcgaggtaggtgccgccccgccgggtcgccggggcggtcagcgcgaggatcccgccgaccgcgaccaggaccccgatcagccacaccccggcgtccagccggaccctggtgtgcaggctgaccagcgcgacggccagtggcggaccgagcagcgcggccggcaggaccagggcgagggcctcggtcgcggccagcgcggtcagctgccggcgggatgcgccacgggcccgcagcagcgcggtctcgctcttgcgcgactccgcgagcagcagcgcgaccagcgacaacgcgtatccgccgaggaccacgacgagcagcatcggggtgaccagggtggaccggcggaccaggtccgcccggccgaggcggccggccaggtccggcaggccggtggtcaccgtggccgacgctccgagacccgacttcgccggcaggtccgctccggtcgcggtcatcgattgcgcggtacgccggatcgagcccagtgtcggcgccgacagatccggctggaccagccagcccgccgacgcgttgtcgaagaacgccgggtcggtgctgacgatcggaccgtaggtggacgtctgcggcagccggccggccgtcacgtcgggcagcagcaaccagtacgggtcggccgggtcgcgtggccgccagacgccgctgaccgtgcgggccaccggcctgccggtccgccggtcccgcactagctagctaggccacctgcccggtgccggccggccacgccccggcgagcaggtcggcgtgcgccggcaggtcgtcgatccggaccagcgacgcgtagaccacaccggacgagtcggggaccgcgctgccgcgggcaccctcgaccgcccagccggagccgtaccgcgcgccactgatccgggccggcgcgtacgcctgccgaatggtcttgtcgcgggcctgcggatccgttccggcggcaccacgcaccagcaccgaccgctcgtccggatcggcgagggcgaccgccgcgcgcaccccggcgccggccgaggcggtggcgtacgcggtcagccccgtcatcaggagcaccgcggacagcatcaccgcggccgccgcggcgagcagtccccgagctgccgccgcacgccggacgatcagcgccatcggcgccccggttcgagcatgcggcgcatcttgccagatgggatcaacaccgggagcccctggcccgtcggcgggattccggccgccccgccgttccccaccattgaccatggtgttcatcgcgtcgggcaccacccgggtcagggtcatcccgaggcgcacgtccgggaacggcggcgggtgagcgaggtcgctcgggtgcgggacggtttcagcttggttgccggttgcgcgtggcgggtcggtcagtggcgttgaccgagcgtgggagggcagggggccgaaggagggtggggccggcggggtgaggcgtgccagagtggcgcctgatgcatgccgggcagggagagggatcgatggacgacgcactggtggcctacaacgccggtcgggtggacggggctgccgggcaccgggacccgcagatcgccgaggatccggaggtgggagcggactaccggatcgggctgctggacgggcggatcgcggcatatcacatgatcaacgaggtgcgggggatcctgggggtcaccgactcgctcttcgatcaaccggatgatccgcgaccggcgtgaccgaactgccggatgacgcgggacagggcgcggatgccggacggcccccgatcggtgtgcggaattgccggtcggtccccgcatggcgtgagaatgcggccggacctccgctgaatggacggcatgccggtcgaccattcggccagaattaaacggaaaaagacggatattcccgaattaggtggaacgaaaacctcgggcggataagccacggggctgctgaccgcgtaccgggaaatcgccagtgagaaatcggcggcggaccgcgccgcgccggatcgccgcaagcggggaaaatgatcgcgtcgccggaacggccgcgggccgcatccccggaaggatgcggcccgcggccgagagaaatccgtgttcagttcttcttccaggggccggggcccccgtgcggtccgtcatggaaatccgggccgtcatggaatccggggccgtcgtggaaccccgggccgtcgtggaaccccgggccgtcgtggaaccccgggccgtcgtggaaccccgggccgtcgtggaagtccggaccgtggtggaagtccggaccgtggtggaagtccggaccgtggtggaagtcgccgggcccggcccacccgtagtacgccttgagcgcccagctgccccgccggaacccgtgccgcaccgggatgcagtcgtggctggcccactggtgacggaattcgccgcggcggccgaccgcgtggcaggccatcgggctgcggtagaaaccgacgatccggtcctgcaggtgcgccttggcctgcggggcggcgggggcctgcggggcagcgggcttctgcggggcagcgggcgcctgcggagctgcgggcttctgcggggcggcgggcgccgacgacgtgccggtcgatgcggcggcgggcccggcggcgacggccaggcccgcggcgaccgccagaccggacatcgcgacaccgcgaatgatcctgttcatgggatcacctttcgttgcaaaaggtaatttcggacaaactgatcatatgaggcatctggcatagcgccgaaagcgacacgtcccacgatcaggtgaccccggtgcgccattcgatcttgaatagcaatgcattttcgcagctcattacggcattgacggagtggcggctgcacagcggacagaaagtgcgaaatgccgacggcccggcgcgtcgtcacgcaccgggccgtcggctgaccgatcagaccgcgatcgccctccgggccccgggccgcaggtagaccacccaggtgaccaccacgcacagcgcgtagaagccgatgaacgccaggtacgccgcgtccgcatccttgtagatcaggaacgactgccggaaggccaggttcaccagcaccccgccgaccgccccgatcgccccggcgatgccgatcaccgcaccggacagccgcagggcctgcggggcgtcgtccgggtacttcgccttgaagatcgccgggatcatcttgtacgtcgatccgttgcccagtccgctgaggatgaacagcgtgatgaagccggcgatgtacagcggcagcgaccgctgctgtgcggccaccaggacgacgctggcgcccagccccatcgcgatgaagttcacgaaggtcaccctggccccgccgagccggtcggcgagcgccccgccgagcggccggatcagcgagccgagcagcgggcccaggaaggtcaggtacgccgccttgatcggggtgttgaactggccggcgaactgcacctgcagcacctggccgaaggcgaacccgaatccgatgaacgagccgaaggtgccgatgtagagcagcgacatcacccaggtgtgcccgtcccggatcgcgtcgcgcatcccccgcttgtcgttgcgggcctgcgacaggttgtccatccagagtgccgagccgagggtggccagcacgatcagcgggatgtagatgccggccacgatcccggggtggccggcgccggcggtggcgagcacggccaggccgaccagttgcaccgcggcgacgccgatgttgccgccgccggcgttgatgcccagcgcccagcccttgtagcggttcgggaagaacgcgttgatgttcgccatcgacgaggcgaagttgccgccgcccaccccggccgtggcggccagcagcaccagcgtggtgaacgagatccccggcctgatcaggaacgccgccaggatcgacgggatgagcagcagggacgcgctgatcaccgtccagttgcggccgccgaagcgggccaccgcgaacgtgtacgggatccgcagccccgccccgaccagcgtcgggacggcggtgagcaggaacttctgcgccgggtcgaagccgtatttcgggccgaggaagagcaccatgaccgaccacagcgaccagaccgagaagccgatgtgctcggagaagatcgagaagatcaggttgcgcttggcgatccgcgacccgccgttcgaccagaaggtggggtcctccggatcccaccggtcgatccacttggcccgcagggtgggacgttcggctaccagggtcatgtcactctcccagaacgatctggccgtcgtcgacccgcaccgggtagacgtcgatcgggggctggccggacggggagcacccggtggctaggtcccaggtgaacaggtgcagggggcagacgacgaccgcgttgtcgatctgcccgtccgccagcgggccgcccttgtgcgggcagaccgccgagaccgcgcgcagcgagccgtcccgcaggcggaagatcgcgatcatgtcgtccccgacggcgtaggtgcgtccttcgccgagggggatgtcggagacggggccgagagtggtcagtgtcttcatgcgcgcaccggaacctgggggaggacgatcaggggcagggaggtacggaactggccgggcgtggccggctcggcccgctccttccaggggtccttgtaggactgaacggcttcctcgacggcggcgtccagggcagcggcgatgccgtccgcgtcgtcgacgacgatctcgcggatccggtcgatgccgacccgcgggacgaacgcgtacgtccgctccagccagttggcgttctcccggtagtactgcaggaaccggccggtcagccggatcacctccgcggccgagtcgaccgtggtgagcaggtcgcccttgcggatgtgggcgccggccgcgccgccgacgtagatctcccaccggccgccgtcgatggcgaccacacccaggtccttgacgtacgcctcggcgcagttgcgcgggcagccggagacggcgagtttcatcttgccggggccttcgaggccctggaaccgctcctcgatggcgatgcccagcgcggtcgagtcaccgacgccgaaccggcagaagtccgagccgacgcaggtcttcacggtccggaaactcttggcgtacgcgtagccggacggcatgtccaggtcggcccagatggccgggagctgttccttcgggatgccgagcaggtcgatgcgctggccgccggtcagtttgaccatcggtacctgatacttctcggcgacctcggcgatccgcttgagctcggccggggtggtcacgccgcccttcatctgcgggacgacggagaaggtgccgtccttctggatgttgccgtggacgcggtcgttgatgaagcgggcgtcacgctcgtcgacgtactcggcgccccacatcatcttgagcagggaggcgagacccatcttgctcttggcgtcctccgcaccgccgggcaccagcgtggcgaagacggacgatacgcttttcagcccgaatcctcggatggcggccatgagttcgggcttgggcatcggcaccccgggcacgtaccaggacgccgccggatcctcctcggcagcaccgccgttggcccactccacgatccgctggaccagcggcttgcaggtgccacaccccttaccggcccgggtcctgtccatcaccccgctgaccgtcgcgcagcccccggcgaccaccccgcagatcgcacccttgctgaccccgttgcagttgcagacctgagcgtcatccgccatctccgcgggcgggacctcccccgccggcccgccgatgtcgaagatcagctcggcgcgctcctccggcagccggactccgctctcgaaagcctggatcagcgactgcgccttgccgttgtccccgacgagggtcgcgccgacgagcacgtcgtcccggatgatcagctgcttgtgaacgcccttgcgcggctcgttgtagacgatcacctcgtcgtcctcggactccggcgcgatcagccccatcgaggccacgtcgatgccggccaccttgagcttggtgtagagcttcgacccctcgtacgccgcgccggcatcacggccggtgatgtggtcggcgagcaccttggcctgctcccacagcggcgcgaccagcccgtacaggttgccgcggtgctgggcgcactcccccaccgagtagatgtcggcctggccccgcacccgcatctggtcgtcgaccacgatgccgcgttcgaccggcaggccgctgcccgccaccatctcggtgttcggccggatcccggccgcgatcaccaccacgtcgcactcgatgaccgtgccgtcggccagcttgaccccggtgacccggtccttgccgaggatctcggtggtcatcgcgttggtgatcacctggatgccgagcctgccctccacactggcctgcagcatccggccggccttcgggtcgagctggcgctccatcaggtggcccatggcgtgcagcagggtcacctggctgacgtggttctgcaggccgcgggcggcttccaggccgagcaggccgccgccgatcaccacggcccgctcgtggtcccgggcgtagcggatcatgccgcgcgtgtcgtcgagggtccggaacgcgaacacgccctggtggtagccgcgcttcgggttgtgcacgttcttcatcggcggcgtccacgagtagctgccggtcgcaatgatcaatttgtcgtacggggtgaccacgccgcggctgtcgacgacggtcttggtggtcgcgtcgatccgctcgaccttgacgccggcgttcagcgtgatgccgttgtcccggtaccacgccaggtcgttgaggaagatgccctcctccgtctccaccccggcgagcaggttggacagcatgatccggttgtagttgccgtacggctcgtcaccgaacatcgtcacggagaagtccccgtcgcgggcgaggatctcctcgaccgtgcgggcccccgccatgccgttgccgatgacgacaagcttctgagtcactgcgtcggtcccttctcctccggtgtgtccgcaactctcgcggtgcggcgttaaccgggaagaccacttgcggtgacactgttgttcggaaatccctacaagcggcggcccgctgttgtgaggaccgcgctgtcgaaccgacccagaacgaggtcggcgacggccgcgtcccggcacagtggcggggtcaccgcgtcggccccggcgccgctcagcgagcggtagaagaggccgtcggcgagcaggtaagcggcgatcgcgatccgttcggcgccctcggcacgcaggccggcgaccacgtcgggaacgcgcgggccgctgccggagacgtagccgacccgggctgggcccggcagccgggtggcgacctgggcgacgtccgcgcgccaggcgggatccgaggatccggccgcggccagcaccacggcgccggccggcggcaggtgccgcatcatggcgtcgagcagcagcgggtccgggccgagcggggcggtgaccgggatgctcgtgccggcgaccgcctcggcgatgtcgacccgcacgtggtagccggccgacagcagcagcgggacgacgacggcgttcggggtgatcgggacgatgtcggcgaccttcggctcctgcacgtcgacgtagcagagtcggacgtccaggccggggcggcggcgggccacggcgccggcgaggtcctgcagctggcggcggccgttcgcggaccgggtgccgtgcgcgacggcgatcagagtgggcacggtgcctcctaagggctttccagcggcatttccggtacgtcgcggcagccgacggctgcgatcgcggaggtggcggtacggcgtgggcagcgcgccgggtcgcttcggtgcgaccctggcggcgtcgccggaccccgcggccgccccggcatgatcatcgggtgccggccgcgcggcgtcaccggtatgaccggtgctccgctcaggctgcttcgtcgacccggagacggtagccgcgtttgatcacggtctcgatgtgcctgccggagccgagggcggcccgcagccgggccaccgccacgtccacggcgtgcccgtcgttgccccgcggcagcgccgccgcgagctgttccttggagaccaccgcgcccggccggcgggccagcgacgccaggatcgccatggcggccggggccagcgcgtggaccgccccgtcgatcagcaccgcgtgcccgcgaacctcgagcgtcgtcccggcgacccgcagccgcaccgcccgccggggcagctcgtcggtgaccgtcttgatcagcgcaccgagccggaaccgttccggcatcaccaccggcacgtcccgctccaccagcggcgccgcggtcaccggacccacgcaggcggccagcgtgccgtcccggaaggcggccggcacgtccacgccggtctccccggcgatctgcaggaacgccttgaccgccggcgcgctggtgaacgtgaccgcatcgatctgcccggcggccacctgctcggccagccggcggaccggggtggtgtcggccggcagcgcccagcggtacaccggcacctcgaccacggcggccccggcggcgcgcagcgcgttcacgaactcggtctgcggctcaccgtgctcctgcaccacgatcttgcgcccggccaccccgtcgtgcagcagccgttcgagcacctcctccgacgcctcggtcttggccgcccagtcctcggagagcccggccgcccggatcgccccgcacggtttcggcccccgggcgatgatcttcgcggctcgcagcgcctcgcgcagcgtctcggcgagtccccagccctcggccgcctccagccagccccggaagccgaacccggtggtcgccaccacgagatgcggctccagcccgatgcacgcctcggtcgccgcgcgcagcgcgtcgtcgtcgatcagcggcacaatggtgatcgccggcgcgctcaccacccgagccccccgccgctccagcagcgcggtcatctcaccgcggcgccgttccgcggtgaccgccacggtgaacccggccagtgcgccctcggtcatccggtctccatcccgtgcggtcgtttccgctgcaagagtcctaaggcctcatttcgggaccggcaaacaaatgtttccacccgaataacgccgactcacttcggccgccgaccgccttgtgaccgcctgatcatcttccggtcacgaccgcgccggctcgggtcccgaccggggcggcgcgctcccgcggaccccgagacgccggtctcccaccggggccgctccgagcccgaccaccagcaccgccacgacaccggccaccggatccggcgacagaagcccctgccgggattgtccgcctcgccaccgcccccgagcggccgaactccccggctgccggcaattttcccgccacccggcgccaccgctgaacccggcaccgccgctgaatcggccgctaccgctgaacccgccgccaccgctgaactcgccgccatcgctaccgctgaaccccgcgccaccactgaacccgccgccaacgccggcccgcctgactggccgacccggcgtcacccggtgccacgggggcggcccctgccatacgactcgcgggtgcatacgggacggtcgcagccagccggggtttcagtgagcacacgcggatgtaggaccggagggcttcgcgttctggacgcgttgcggccagcgaagcccgcagggaccctcggcgggagcggcgatcagttatcggccgcagcgcacgacatcaagatcttgaagttgatcttgatttttccgcacgaaagcgccggcccgcgccttcggaggacgcgagccggcgcggccccggccggaagccgggacgtctgccatcgggatctcctcgccgacgaccgccccagggggatcatgcggtcggcggccgcctcaggaggatcatgccgtcggcggccgcctcagggatctcctcgtggcgggccttcttatcgcgggagtaggccgctcgccttccacagcgccttggccgggccgccgccgatgaggtccaggtcggacaggtatccgacgatgcgttcgccggcccagcgcatcgtctcccggtggtaggggttggcgcgggcgacgcggcggccctcctccgggtcgatgccgacggcgcggtagacacgcgggtcgatgaggcgggtgccggtgaggtaggcggctcgggcgatgaccaggcggtcgaaggcgagccgggatttgccggcgaggcggatctggcgggccagttcctcgcgggcgaaacggacgtggcgggcctcttcgacgacgtggatccgggagaccatccggaccagcggctggacggtctcgtcggccatcgcctcgcgctgcagggtgtccaggatctcctcggcgatcaggatggcggcgaacatgcgcggaccggtggcggtgtgcgcgatccaggtgccgaggaactggttgatgccgtcggggcggtagaccggggtgtcgagccgggcgatcatcttgccgaacatgatcgagtggcggcattcgtcgccgatctcggtgagcgcgtactgggcgtgcggcgaggtggggtcctgccggtagtagccgcggaccagcagctgcatcaggatcgtctcgaaccagacgccgaggccggcgatgctggcgacctcgtgcttggtgagttcgatgcgctgctgctcggtgagccggtcccagagcgcggtgccgtacaggctggagcggtgcaccgggacgaagtacttgccctcgacgaacggggcgtcccagtcgatctcgatctccgggtcgtaggagtgctcggcggaggagcgcagcagccggctggcggtgcggtcccggtcagtcactgtcatcggtcctccagagagtttcgcttggtgacgccagtagttctcgacgccatttgttcttgacgttaccggcggtaacagttacttctagtactatgaactcggtcaccccacccgtcaacaccgatggccgccgcggccgttgggacagtcatcgcgagcagcgccgcgccgagctcaccgccgccgcgatagaggcgatccggcagcacgggccggaggtcgggatggaggcgatcgccgcgcacgccggggtgagcaaaccggtgctctaccgctacttcagcgacaagtcggagctgtggctcgcggtcgggcagcaggccggcacgatggtgctggaggcgatgatcccggcggtcgcctcggtccgcgaggagcgggccgcgatcgcggcggcgatcgacgtgtatctgacgcacatcgaggccgatctcaacctgtaccggttcgtggtgcaccaaccggacatcgcccggcaccgggacgtggtcgccgacgtggtggacaccgtggccagcggcctggcccggatcttcggcgaccggctgcgggcccgcgggctggactcgggcgcctcgctgccgtgggcgtacggggtggtcggctacgtgcagtcggtcggcgactggtggctgcggcagcagcagccgatcagccgggaggcgctcggcgaatacctgacgacgttcctctggggtggcgtcgccggcatcagccgcgcggcggacatgcccggtggcctggcagcgcaagcggaagggtggttgcaggcatgaccgatgaggaggagtaccggggcccggcacttctgaggatcgagggaagtgagttccccgtcgacatccggatgtcgtcgcacttcgagccgatcgaggggcggttccgctgggcggggcgcaccaacccggtcgacgagctgcgggaacgggtcagcggcgggttgcgcaaggcgaccatcgcgattccgggagcacccgacaccgcggtgcggttgagcgagccggacccgtggggcggggtccggatcagcgggacgggcactcccccgtggttcccggcggtgccggcatgaaccacttcgacatgctgatcatcggcgccgggctctccgggatcggggccgcctggcggctgcaggaccagcggcccggcgacacctacgcgatcctcgaggcgcgggacgcgatcggcggcacctgggacctgttccgctaccccggggtgcgatccgattcggacatgttcacgctgtcgtatccgttccggccgtggcgggagccggagtcgctggcgtccggcgacaagatccggcggtacatcgaggagaccgcggcggaggccggaatcacccggcacatccggttcgggcgcaaggtcgtcagtgcgaagtggtcgtcggccgaggcccgctggacggtgcggaccgccggcggcgaggtttacaccgccgatttcgtgtacgcgtgtgccggctactacagctatgccgagggctatcagcccgacttcgcggggctcggggacttccgtggccgcgtcgtacatccgcaattctggccggacgatctcgatttccacgaccggagggtcgtggtgatcggcagcggggcgaccgctgtcaccctggtgccggcgatggccgcggacgccgcgcacgtcaccatgctgcagcgctcacccacctacgtgatcccgcagccgaaccgcgacgtggtcgcgaacgcggcccgcaggctgctgccgccgcacgccgcgaaccgggtggcccgggccaagaacgtgctggtcacgcagctgttctaccaactcgcccagcgacgcccgaagctggtccggcgggtgctgcggggcgtggccgggcgctatctgcgcaccccgggatacgtcgacacgcacttcaacccgcggtacgacccgtgggaccagcggctctgcgtgatcccggacggcgacctgttccgggtgatcgcggacggccgggcctcggtggtgaccgaccacgtcgacgcgttcgtgcccgaggggatccggctgaggtccggcaccgtgctggcggcggacgtggtcgtctcggcgaccggcctgtccctgctgccggtcggcggcgttcaggtgagcatcgatggaacgcccgtcgatatcggtcagcacgccgcgtaccgcgggatgatgctgtccggggtgccgaacttcgcgtactgcatcggatacgtcaacgcctcctggacgctgcgcgccgacctctcgcaccgctatgtgctcaagctgctcgaccacatggcccgccacaacctggccgtggccacccccgccgaacccggcgcggccggccggccgctgctcgacctgagctccggatacgtccagcgggccctcgacaagttcccgcgccagggcgaccgggacccgtggctggtccggcagaactacctgcgggacgtggtcgccaccccgcgcgccgacgtcacccaggacatgcgtttcaccccgcgctccgcccccgtccctgcttccaaggtggtctgatgccccgactcgatccctaccggttcgccggtcgcaccgccgtgctcaccggcgcggccagcggcatcggtgaacagctcgcctacggcctggcccagcgcggcagccacctgatcctggccgacgtcgacgccgcccggctcgacccggtcgccgcccggatccgctccgcccacccggcactctcggtcgagacggtcgtcgccgacctgtccgaccggtccgctgtcgacgccgtcgcggcccgggtgccggccgccatcggactgctgatcaacaatgccggtgtcgccctcggcgggcgcttcgaccaggtcagcgtcgaccagttcgagcatgtgatgaacgtgaacttccgcgccccgatgctgctgacgcacgcgctgctgcccgccctgaccgccaccccgggcggccacctggtgaacgtctccagtctcttcgggctgatcgcgccgcccgggcagagtgcctactgcgccagcaagttcgcgctgcgcggtctcagcgaatcgctgcgcggcgagctgttcgagaacggggtcggcgtcaccacggtgcaccccggcggcatccgcacccggatcgcggagagcgcactgatcggcgagggcgtgccggaatcggacatcgcgccgacccgcaaactgttcgccgcgctgctctccttccccgccgagaaggccgccgagcagatcctgcgggccaccgagaaacgcaaggcccggctgctgatcgcggccaacgcgaaaggccccgacctgctgcaacgcatgctcccggtcggctccggcaccatcatcagggcgctcaccgccgccacggtcaagaccgcggggcgcgccaaggcgggtgccacccgatgaattacctggacgtacgcggttcccgcatccgtttccacgagaccggcgacccggccgccccgccggtggtgctgctccacgggatcgggcgcagcctggaggactggtcactgcaacacccccggttcgactcggactatcgggtgatcagcatcgacatgccggggttcgggctgtcccggcgggtgccggccaccaccaccctgccggtgctggccgacgcggtgtgggcgacgctggacgagctcggcgaaactcgaccggtgcacctgatgggcaactcgctgggcggcgcggtgtcgatgacgatgctggccggcaccccggatcgggtgacgacgctgaccctggtgaacagcgccggcttcggcaaggaggtcacctgggcgctgcgcgtgatggccctgcccggcctgggtcgcacgatgctgcgcaacatcgacaagcgcaccgccccccgggtcgagcgaaccctgttccgcgaccgcgcgctggtcaccccggaacgggtggagatggccatccggatcgcccagcagcccgacttcgccccggtgtacctggaggtcgccaaggccctgggcggcctccgcggcgtagcagccccctggcggaccgcgctgctcgcctccatggccggcctcaccacccccaccatgatcgtgtggggcgaccgcgacatgatcctgcccagccaccacatggccgcggcccgggccgctttcccgcatgcccagtcgcacatgttcccggagaccgggcacatgccccagatcgaacgccccgacgagttcgcggccctggtccgccccatgctcgccgcggtccccgcctgataccgggatccgggcgacgaaagggggcgccgcccggatcccctcccctcgcttgcggccgcaccgctcgccgcttcccctccgccgcccggatcccctccctccgcttgcggccgcaccgctcgccacttcgccctccgccgcccggatccccttcctccgcttgcggccgcaccgctcgccgcctccccttccgccgcccggatccgctccctccgcttgcggccgcaccgctcgccgcttccccttccgtctcccttcagcttccgcgccggacgcccctccgactttccacgccgggccacctccggcggctgtccaccttcctgtggcaatcacccgacggtggagttgcggaaccagattcacgcggttggatggaaccatgcgccgagcgatcctgttgttcgtcgcgctgatcgggggattgctcgcgggctgcggctcggcatcaccgaaagcgccggccccagccctgcccgccgtcaccggcacccacccggtgggttcggttcaagacctgcagaccgccgattcgtccgtgcgggtcaaggtcgccgccgccggcgcggccgccgaccgctacgtggtgcgggtgaccgtgcaggtcctccgcggcacctacgagttcaacccagtcctcctccatctccgcgacaccaccggcgccgacaccggcccggtccccggccggtcccggccagcgaccgctttcaccctgcaccccggagtcaccctgagctggcgtgtccccttcccgcaccccgcagccccggacgcccaggtcgtcctcaccagccgatccggcaccgccctggcggcctggaacacccgccccgccggcaccccgtaacggccgtcccccgtcaaccacgccgctctgcggtcgcctcccagcccggctccgacggcgccgcccagccgggcctgctatccgctcgtcgtgccgtccgctcgtcgtgccgcccactcgtcgcgccacccgctccccctgccacccactcgccctgccacccactcgccctgccacccactcgccctgccacccactcgccctgccacccactcgccctgccacccgctgccttcaaccttgcggcggtcctgctcggcgggcgttgcacctgtcctaggcttcggtcatgaccactccccagccgcaggatctccgtctgctggaggcgttgcactccacgccggcccgccgctacctttccaccgagccgatcgccgacgacgtgatccgcgacatcctggacgccgcgatccgcggcccgtccggcggcaacagccagccctgggtctggatcgtggtccgggacgcggacaccaagaagcagatcgccgactggtaccgggagggctgggaacgccactacggctcccgccgcgaggagatcctcaacgcccccgacggcggcccgatgtccaagcgcagcttcctggccgccgaccatctggccgcccatctggaggaagcccccgtctggatcatccccgccatcctcggcgccgcgaaatccagcaacccccgcctgggctcctccatctacggcgcggtccagcagctcatgctggccgcccgcgcccatggtctcggctccactctcaccactctgcacatcggtcacgaagccgacgtccgcgacatcctcggtctgccggagaatgccctcaccatggccctgatcccgctcggctacccgagcaagggccgctgggcccagccgaagcggcgtcccctggaagaagtcgtcttcttcgaccgctaccagcagtaaccaccggccccggctcacccaccggtcggccggggccgcgccgtcggtccctcccccggacaccgcgcccggacaccgcgcccggtcgtcgcccaaccggcccaccagccccgccgccagcccgggcgaccgcggccgaccacatcgccgaggcagcacaaccattcatccactccaccccccacagctcgggcgctccagcccaccgatgccgcacgtcctgatcaccgcgagcggcccaggcgcaccgaccgcaccgcccgtcggggaaggccccggcccgagcggcgtcaccagcctcccgagtggaggttcggcccgtcaaccgtgcggggcggtgggcgcactcggttctcctgacagatgaattgcttggtcaggcgggtggccggccggaatattggcccgtgggacggaaccggaccgggtggttggcgtactcctccagagcgtgcgccagccagcccgcggtgcgggcgatggcgaagattgcctcgcccgcgtcggacggcataccgaagtggagggtcagcgtggcgagcgcgagatcgatgttggggtggatccccgagcgggcctggaccgcgtcggccagcgcggtcgcggcccgccgggcgggatggtcaccgagcagccggaggatggtgatggcgcgcggatcaccgttctggtaaagcagatgcccgaaaccgggaatcccgccggagacccgcaaccgctcggagatgatcgcaaccgggtccgcgccggccagcgcttcgacgagcagcgggtggacgtactcactggcggcgccgtgcagcggaccgtcgagggccgccaggccggcgctgaccacggcatagggatgcgcccgggtcgacgccgccacccgggcggccagggtggaagccgcgatgtcatggtcggccagcaggatcagcgccgcttccaggacccgccgtcccacctcggtcatcggctctccggtgagcctcggccacagcaactcggcgatcgacccgggaccccccgccccggtcggcgccgacggatccgatcggaggatgtctaccggctcccgggctgaccggagaggcagggccgcgaccatggtggcgatcagggtgcgaccggtggtgacgacagcggcggggctggtgtcgaagcggaacggatcggcggcggcgatggcggccaccgtgacccgcaggcggtcggtgaggcgggccgttgccggcagcagcgcgcccacccgctccgccagcgccaacgatgcgcgactgaccgcgaacggcgccggctccagagcgccgcccccgtccaggcccggctccgggtcgtgcgggccggtccagagcagggtggcgaccgcttcataggtcgaggtgcgggccagttcggtggcgtcccgtccgcggtagaacagcgcgccgtcgcggatcagggtgatgccggtctggatgttgggggtggcgcgtttgcggccggcgagcagggcgtcgacgtcggccttggcgaacaggctgcccttcccggcggcgttgcggcggctggggagcaggccacggctgacgtatgcgtacaccgtcgccggtttgacgccgagccgctgggcgacctgatcggtggtgaggagctgctccgacatgtgcacatcatctcatgttgaccgcatcaacattgacggcacatccatcaagtcgtcatgttgagagcatgttgacagtgaatccaggacttgccggtgtcgtcgccttcgacaccgagatcgccgagcccgaccgcgacggcggctccctgcgctaccggggtgtggacatccgttcgctggcgggaaacgtctcctacggcgacgtctggggtctgctcgccgacggcgacttcacccgcgcgctgcccccggccgagccgtccgccgtcccggtgcgctccggtgacgtgcgcgtcgacgcgcaggccgcggtgtcgatgctcgccccgcacctcaggctgcggcaactcatcgacatcgacgatgtgcaggcgcgcgacgacctcgcccggacctcatccatgattctttcgtacgtcgcgcaggcggcccgcggcgcgcacctgcccgtgatcccacagcggctggtcgacgcgggccgcagcaccaccgaacggttcatgatccagtggcagggtgagccggatccacggcaggtggcggcgctggaccggtactggatctgcgcggccgagcacggcatgaacgcgtccaccttcaccgcgcgggtcgtggcgagcaccggcgccgacgtaccggcctgcctgtcggcggcgatctcggcgctgtccggcccgctgcacggcggcgccccggcccgggtgctcggcatgatcgagcaggtggagcgcgccggggatgctcgggcgtacgtccgcggggttttggacagcggtcagcggctgatgggtttcggtcacgcggtgtaccgggccgaggatccccgcgcccggatcctgcgggatgcggcgttcgagctcggcgcgccgcgtttcgaggtggcccgggacctggagctggccgccctcaccgagctgcgcgaacggaaaccggaccgtgtcctggagacgaacgtcgagttctgggcggccgtgatcctcgacttcgcgggcgtgcccgcggagctgttcacgtccctgttcgcctgcgcgcgcacggccggctggagcgcgcacatcctggaacagaagcgcctcggcaagatcatccgcccgtccgccgactacgtcggcccggctcatcgcccggccgaagcgcttgccggctggtccgacgccctgcaccgcaaccgcctgcccgggaacgtgaccgcatgagtgcggacaccgccgatctcgggcagcccgtcgccgacttcggaaacgccaaggacttcggacaggccgcggcaggcttcggcgaaaccgtcgatttcggacggaccgccgccgactacgcccggcaccgggccggtttcccgcccgcgctgatggaccggatcgacgacgtcgccggccggaccgtgctggacctcggcaccggaaccggcagcctggcccgtcttttcgccgcccgcggcgcggtcgtcaccggtctcgacccggcggagccgctgctggaccaggctcgtcgcctggatcgggaggcaggtttgagcatccggtacgtcgtcggcgccgccgaatgcatccacctgccggacgccacgttcgacctggtcaccgcgggtcaatgctggcactggttccgggccggcgaggcagccgccgaagtgtcgcggctgctccgtccgggcggccggatcgtgatcgcgcacttcgactggctgcccctgccgggcaacgtggtcgccgccaccgaggagctgatcgtggcgcacaacccggcctgggcgctggccggcggcaccggcatccatccgcgctggctcaccgacctgcgctcggccggcttcaccgggctggagacgttctccttcgacgtggacgtcccgtactccccggtcgactggaccggccggatccgcgccagcgcgggcgtcgccgcgagcctgccaccgcccgctgtcgagcgcttctcggccgaactcacggccctgctggagcgcgacttccctgccgacccgctgctcgtcccgcaccgcgtatgggccgtcgtggcccgcaaaccggacgaccggtagcgcaggcccggtagcgcaggccccgccgatcgacggcgaccagtccctgccgatcgacggcgatgaagaccagcacccgccggtcgacggcgagcaggtcccgccgatcgacggcgacgagaaccagcacccgtcggacgcggccctgcgggtgaagagcccgcacgcggaacgcaccgacgggtggcgggtcgcggtccgcgccctcaggaggcaagggccgcgtaccggccgccctcggaaagcagcgagtcgtgggtgccggattcgacgatccggccgtggtcgatcagcacgatctggtcggcgtcacgcaccgtcgacaggcggtgggcgatggtcaccgtggtccggccgcgggacagctcgtcgaacgcccgctgcaccgcgcgttcggtctcgttgtccaacgcgctggtcgcctcgtccaggaccaggatcttcgggtcgcgcagcagcgtgcgggcgatcgcgatccgctgtttctcgccaccggagaagcggtggccgcgcgagccgaccagagtgtcgtacccctcgggcagactctcgatcagcgcatggatctgggcggcccggcaggccgcctcgatctccgcgtcggtggccgtgggcttggcgtaacggaggttggctcggatggtggtgtgcagcagatacgtctcctggctgaccacgccgacgatcgtggacaggtcggcgaggtccaggtcgcgcaggtcgacgccgtcgatggtgacccgtccggcggtggggtcgtgaagccgggcgatcagcgccgcggccgtgctcttgcccgagccggtctcgccgaccagcgccagcgaggtcccggcgggcacgtcgaggttgacgtcggccagcgcggctcggccgccgagcgcatcctgcttgacctcagaccgcgcggacctgcccgccggcccgtccggtttgatgccgaccggcacgtcacggtcgacgccggttccgccggagacgccaaccggcgcatcgcggttgacatcggtcgcggtggaggcatcggtgtcgtacgcgaaagagacgttctcgaagcggaggtgaccgcggacctccggcagccggatcggcgaggccggcgacgcgatctcgaccggcaggtcgagatattcgaagatgcgcgcgaacagcgccagcgagctggtcatcgtgacgctgacgtcgagcaggctcatcagcggacggaagaggttgccctgcagcgcggtgaaggcgaccagcgtgccgatgctcatcccgccggccgcgaagggcaggcccgcggcgagatagatggtggccggaatgatcgcgaagatcacgctcatcgccgccatccgccagcgaccggccagttcggagcgcagttccaggtcgatcagccggccggacgatccggtgaaccgctcgacctgtgccgcgcccgcgcccatcgtcttgctgagctggatgccgctgatcgacagcccctcctcgatgatcacgttgagctcggcgagttcccgctgacgttcggcggtgatctgccggcgcatccgggcgacccgccgggtcagatagatcgccggcggcagcacgagcagcgagatcagggtgagctgccaggtcagcgcgaccatcgcgacggtggtggcgaccacggtggtgaggttggccgcgatgctcgtcgcggtcgacgtgaccacggtctgcatgccgccgatgtcgttggtgatccgggactgcacctcgccggtgcgggtccgggtgaagaaggcgatcgactgctgctgcaggtgggcgaagacgtcgacgcgcagccggtgcatgacccgctggccgacggtggtggagatccacgtctgcagcacgccgagcaccgaggtgatcgcggcgaccacgatcatgccgagcaccagccaggacagcaggtgcagatcgccgtgcggcagggcgacgtcgatgatctgccggaggaggaagggggtggccataccgagcacggatgacaccacgatgatcgccaccacgacggcgagctgccgccggtgaccgatgaagagcgcgccgatgcggcgcagcgagacggatcgggcctgcgccctctccgcgggggtcacggtgcgtgccgcgccccggcctggtcgttccgccaagagcaaaacctttcctgtgtacggggatggccccgccgtcgaagaccaaccggacacggcgcacgcaacgcggtgcgctcaccgtggtggtgtctacggtggtggcccagcaagctgaggttacctcaccatgagggagcaacggtaattgctggtacgttgttcccgtggaggaagagtcgctcaacgacgcgttctgggcggtcagtcgccggctgcgtgagcaggcccgcagcgagatggagccgtggggcgtcgcgccgtcgcagttccgcgcgctgagcgtgctactcgcccacggtgacatgcgactcagtgcgctggctgagcggctccggatcgccccgcggtccgccaccgaggtcgtcgacgacctgcaggagcgcggcctggccgagcgccgccccgaccccgacgaccgccgcgccaccctggtcaccctcaccgacctgggccgcaccaccggcgccgagatcaaagccgcccgctccgccgccggccagcgggtcttcgccgccctcacccccgacgaccaggcgcagctcgcccgcatcctccgccagctcacctgaccgcgcactcccacaccgccgaccaggcactccggcacgacgggtgaaacgcccggcgcgcgcgatgagcggcctggagatcgaacagcgcggggatcgcgcggccaacgatcgcccggcgcgagggtggggcagcgcgagggtagggcagcgcgagggtgcggcagcgcgagggtgcggcagcgcgagggtagggcagcgcgagggttgagcggcgcgagggttgagcggcgcgagggttgagcggcgcggggggtccaaggatcgcgcggcgcgaggattgggcggcgcgagagttgggcgggctcggggaggggtcagaggagggagcggcggaaggcgatcgcgccgcagccggctacggcgcccaggcagaggatggtcaggtacaggccggccggcagggtgaccagcgatgtcgcggcgaggacgccgaggaccagcagggcgaccaggcaccaggtcagggccacccgcgcgacgtagccgatggcgtccttggccaggacggcgcgctcgtcgacgcggccggtcggcccgacccggagtgactcggcgaatccgtcggcggcctgcgccagggaggcggcgtccaccaccggctccatggcgatctcgaacagggccagggtgcggtgcgcggcggcgtgccccggttcgagggccagggcgcggccgacggattcccgggcgctgagcgggcggccggcggcgaacagggcgcggccgaaggtgacgtgcaggtcggcgtcgtagtcggcgagctcgacggcgatcttcaggttgtccagggcgtcaccgacgtggccggcggcgagctgggcgtcggccaggcggttgtgcagccgcgggttgcccgggtcctcgcggcaggccgcggccgcggcttcgatcgcttcgcggtgccggccgagttcggtggcggcgcggctgagccagtacagggtttccggcccgtgcgggtcgaagtgccaggcggccttggcggcgcgcagaccgccgtcgaggtcgcccatctccaggtgcgcccgggccatccggtgccaggcgtcgacgttctccggttgccggccgacgatcggcgccagcaggtgggcggcgttctcggcacgaccgcggtcgaggaggtcgtcggcctgggagaggaggggctcggttcgcacgaggctgaagatcggccggggccgcgccgacctcggcgattcccacgttgcgaccgggttgcgttattccgcgcggagctcgtcccggtaggcgagcagcgcctccaccatcccccgcacgaaacgctccaccacctgcagctcttcggtatcgaaccgggccatgaccgcatccgtgcgcggcgccaacggctgaaagaacgccgcggccagcgccattcccgcctccgcataccgcaggtggacgactcgccgatcgctgctctcccggctgcgccgcagatgcccgccccgctccagacggtcgatcatcgcggtcgtcgccccggaggacagtcccatcgtctcgccgagccgcccgggtgtgagcggctccccggcgcgctccgcgtgcatgacggcgaggagcgcgtgcaggtcgggcccgtgcagccggtggcgtccggcgaaggcgtgcccgatgtggttggcctcgctggaataggagttgagcaggtcgacaagccgtgaccggagtcgctggcgttctgccttgtccgcttcgtcgggcgctctcgtgtcctccacgggggtaagtgttgcagatcccgcaaccctcgtggagaatctcgattatcgagattcttattcatggaggattcatgagacgggcatgggtttccctgctcctggccctgctgctgggcggcctggtcatcggcctcgccggtgaaacccgggtcgacaacgaccccaccgcctcgctgccgtcctcggccgagtcgacccgggtcgcgcgggcgcaagcaggccgccccaccgcggccctggtggtggtcgccaggggcggccagccgctggccgacggcgacctggtcaccgtcaccccgctgggccagccgatcgtcagccaggaccgcagggcggcgatcgtctcggtgccgctgccgtccggcgtctcgtcggacgagaccatcaagcaggtccgcgatctgcgcaccagggtgcgggccggcctgccggccggggtgaccgcccaggtcaccggtggcgccgggttctccgccgacctggccgacagcttcaccggggcgaacacccggctgctgctggtcaccgtcgtcgtggtggcgctgctgctgctggtgacctatcgcagcccgctgctctggctggtcccgctgatcgtggtgggcctggccgaccgggtcaccaccggcctgatctcgctgatctcgcagcacaccagcctgccgatcaacggttccaccacgggcatcgtcacggtgctggtcttcggcgccggcaccgactacgcactgctgctgatctcgcggtaccgggaggagttgcacgccgtcgacgaccgcttcgaggcgatgcgccgggcgctgcgtggggccggtccggcgatcgcggccagtgccggcacggtgatcctgagcctgctcaccctgctgctggccagcctggagagcaacgtgtcactgggggtcacggcggccgccgggatcgcggtggcggcactgttcgcgctgctggtgctcccggccgcactggtggtctgcgggcgcggcctgttctggccgttcgtgccgcgggtcggccaggacggcgtcgaggcggagaagggtgtctgggcccgggtcggccgggcggtgtcccgcaagccggtcgcggtgacgatcgtctcgatcatcgtcctgggcgtactgtccgcgggcggtctcggcacccggctgggcctgtcgcagaccgagcagttccgggtgaagtcggagtcggtggccggcctggagaccctgtcgacacacttcccggccggcgcggccagcccgaccgtggtgctgaccggccccgatcaggcgcaggcggtgctggccacggtgtccggcacgcccggcgtggcgcaggcacgggtcgtggagcagggctccattcaggtgatcctgaacgcggcgccggacacgaaggaggcgttcgacgcgatccgcacgctgcggacgagtctggctggccgggccctggtgggtggcagcgtcgcgaccagtctggacacccgcgacgcgacccgacacgacctgcgggtgatcgtcccggtgatcctgctggtggtgctgctcgtgctggtcgtgctgctgcgcgcgctggtcgccccgctgctgctgatcgtcacggtgatcatcagtttcggcgcggcgctcggggccggatcgttcctgttcgggcacgccctggacaaccaggtgccgctgttctcgttcctgttcctggtggcgctcggcgtcgactacaacatcttcctggtcacccgggcccgggaggaggccggcaagcgtggcacccgggacggcatggtgcacgcggtcgcggtcaccggcgcggtgatcacgagtgccggcatcctgctggccgcggtcttcgcggtgctgggcgtgctgccggtgatcacactgacccagatcggcgtgatcgtcatgatcggcgtcctgctggacacgctcctggtccgcacggtgctggtgccggccctggccaccatcctcggtgaccggttctggtggccgggccggccgcacagcgccgcgccgaacgcgccggagttgatcagcgcttagcgaggctgggcaccccggcgaacgggatcgccgccggcgccgtgtccttctcccccgccgggtgccgccacaggccccggcggcggagctcgggcagtacaccttcgccgaaccagtacgcctcttccaggtgcgggtacccgctgaggatgaactcggagatgccgagcgcggcatactcctcgatccggtcggccacctcggtgtggctgcccaccagcgcggtgcccgcgccgccgcggaccagaccgacgccggcccacaggttgggcgcgacaagcagcccgtcccggttgccgccgtgcagttcgagcattcgccgctgcccctcggactcgctggtgcgcaggccggcctgcacgccggcgatgtcggcctcggacacgttctgcagcagccggtcggcctcggcccaggcggcctcggcggtgtcccgggtgatcacgtgcagccggatgccgaaccgcatgtccggcttcagcgtccggatccaggcgagtttctcggccacctgcgcgggcggctcgccccaggtcagatacacgtcggcgtgttcggccgcgaccgggcccgcggctttcgacgacccgccgaaatacacggtgggtgcgatgtccgggacccgggcgaggcgcgcgttctccaccttgacgtgcgtaccgtcgtacgaaatggtctcgccgcgcagcaacccgcggaccaccgtgaggaattccgcggtccgcgcgtagcgcgcgtccttgtccaggaagtcgccgaactggcgctgctcggcggactcgccgccggtgaccacgttgagcagcagccggccgccggagagccgctggaaggtcgacgacatctgcgcggccagggtgggcgagatcagcccggggcggaacgcgaccaggaacttgagccgctcggtgacctcggtgagcatcgcggtggtcagccaggcgtcctcgcaccacgcgccggtgggggtgagcgcgccgacgaagccgagctgttcggcgctgcgcgcgatctggccgaggtagccgatggtcagcgggcgcactccgccggccgagccgaccggtgtgccgtgaccgccacccacgatgtcccggctgtcgccgttggtgggcagaaaccagtggaagtccatgcccgggagcttatccagaaaacccatgtaacagataggcgaggtgcgcgattcggatcacggtccgccgctggtcacgatcgtctcctgggggtacgccgtggcacgcgagcgggccgggacgatggtccgtcccggcccgctcacgtcgtaccgctcaggacttgaagacgtccttgatcttctcgccggcctgcttgatgttcgcgctggcctggtcggcgtgaccctcggcctcgagctgctcgtcgtcggtcgccttgccgacgccctccttgaccttgccgccgagctcctcggccttgttgtccaccttgtcgtcgaaagccatctcatacctccaggtggtgaagtcgtgtcgaactgtctggtaccccgaggcggcgcgctccatgcatccgcgcctcatcggtcacagcgggttatggtgggcgccgatccggggagcgtgcatgccgtccaggaaggcacctgcaagaactttcatcaacaaggccggcagcgtgccagaaaaaatcgcaaaaggtggcaaaccgacgtcgagtgacgtggccgcggcggccggcgtgtcacggtccgcggtgtcgttcgcgttcaacaatccgcagcggatctcgaccgccacccgggagcggatcctggcggtcgccgaggagctcggctacaccccgagcacgctgggccggatgctgcaggccggcaccaccaactcgatcggggtgctgctgccgcagcggctggcgcaggtcatggagaacccgtacttcgcgcgcttcctgatgggtgccggccaggtctgcgaccgcgagggttacaccctgctgctcaccccgccgctgcaggactcggtgctcaaggccatcccgtacgccgcggtggacggcttcatcgtctgcggcctggagatcgaccggggcgaggtggccgagctggaccggcgcgggatcccgttcgtgctgatcgactcggaccggcacgagggtgccccgcacgtcgaggtcgacgatcgcggcggcgcccgcgaggtcgcccgccacctgctggaactcggccatcggcggatcgcggtgctctccctgggaccgcggtcggcggacgggcaccggggaccgctcgcgcgccggctggccgggatcaccgatgcgctcgccgaggtcgggctcaccctcgccgacgtgcagctggccgaggtgccggtgacccgcggcgacggataccgggcgacgaaggcgctgatgtccgacgcgaaaccgaccgcgatcctggccctttccgacgtcctggcctacggcgccgtggatgcgctgcaggagctcggcgtcgacgtccccggccaggtgtcggtgaccggtttcgacgacctggccgagtccgcctggttccgaccccggctgaccaccgtgcgccagccgatcgtgaccaagggccggatggccgccgagttcctcgtgtcggccatgcggggcgaggatcagcacccgcagcagacgctcgggacctccctgatcgtgcgaaattccaccgcaaaacccgcataacgacggcttgcaagaacttgctgaaagaaagcagccgtcaggctatgtaacacgtgttagttgcctgctaccgttcctcgccatgaccgaccaactgatcgcaccgcccactgtcgaggcgccgccggcttcctggtggcgcaacgcggtcatctaccagatctatccccgcagcttcgccgactccaacggcgacggcatcggcgacctgccgggcatcagcagccgcctgccgtacctgaaggatctgggcgtcgacgcggtctggctctccccgttctacgcgtcgccgcaggccgacgccggctacgacgtctccgactaccgcaccgtcgacccgatcttcggcaccgtcgcggacgcctccgagctgatcgccggcgcgcacgcgctgggcctgcgggtgatcgtcgacctggtcccgaaccactcctccgaccagcacgagtggttccagaaggcgatcgccgagggccccggttcgctgttccgcgagcgctaccacttccgccccggcaagggcgagaacggtgagctgccgcccaacgactggccgagcatcttcggcgggccggcctggacccgggtcgccgacggcgagtggtacctgcacctgttcgccccggagcagcccgacttcaactgggagcacccggcggtccgcgacgagttcaagaccatcctgcggttctggctcgacctcggcgtcgacggtttccgcatcgacgtggcgcacggcctggtcaaggaggccggcctgccggacgtcggctcgcacgccgaatggcacctgctgggcgtcggcgagagcccgtgcttcgaccgcgacggagtgcacgagatctaccgctcgtggcggcggatcctcgacgagtacccgggcgaccgggtcgcggtcgccgaggcgtgggcgccgaccctggcccgggtggccgactacgtccgcgacgacgagctgcaccaggcgttcaacttcagctacctgggcaccgcgtggaacgtgcacgagcagcagcagatgatcgaggactcgctggccgcgatgcgcgccgtcggcgccccgaccacctggacgctgtccaaccacgacgtggtccggcacaccacccggctgatgcagaccgcggacggcgaggtggccggccgcaaagcggtcgccgtcgacgaggcggccggcctgcgccgggcccgggcggccagcgcgctgatgctggccctgcccggctcggcctacctctaccagggtgaggagctcggcctgcccgaggtgctcgacctgccgccggaggtccgccaggacccggccttccaccgggcgaccgggcaggacggctaccgcgacggctgccgggtgccgatcccgtggagcggcgacaccgcgccgtacggcttcgggccggacggcggcggcagctggctcccgcagcccgcctcgtgggccgggctcagcgtctccgcgcaggccgggacgcccggctcgaccctggagctgtaccgtgccgcgctcgccgagcggcgggtcaacccggcgctgcagccgatcgacaacctgcgctggctcagcgcgccggccggggtgctcgccttcgagcggtccgtcgagggcgccccggtgttccgctgcacggtcaacatgggcgaccagccggtgaccgtcgcccgccccggcacgccgctgctggccagcggcccgatcgagctcggcccggacgaggtcgagctgccgccggacaccaccgtgtggtggtccgtctaagcctggaaaccggcccggccacccgtggacggtacgggtgggcgggagtgcgggtgtgacgtgccttggggggtgagcgtcacacccgcactttatccttttcaagatcaacacacgatgcgccggtacgccgatggccgcaccccttctgcgactcttctcagctcacccgggatgccgccgatcgtgccggacatgcgaccagtgggacgaccggcccgcacggccgggcgcattctgctcctggcctgtgtctgggccgggctgagcatcgtgctcgggatcgccggcatgctcagcgaccacccgccggcctggctgctctggcccaccgggatcgcggcggccgccaccgcggcgtgggctgcccacaccgcggcggccggcaccgagggcgacgcgcaccggttctggcggcggctgaccatctcggcctgcgtgctgaccctcggcaccgtcagccacgccatccggaccaccctggccgggcatcccatgccgatgaacaccctgagcgcggtgtgctatctcggctcggtggccggaaccgcgtacgccatgatccgcctcccgcacccgccgcggacctggcgcgccaatctcgcgatctgcctcgacatcgccatcgtcggcgtcgcctcggccgtggtcatcacgcacttcctctggtcgatgccggtgcccggcggcccgccgacgggtggcccgatgccggccggcgacatgccgcccggcccgatgccgcagctcggcctggccgccggcctgatgctgatcgtcctggtcaccgcgatcaccgcggtggtcgcggtgatccgggtcgggatcaccggcgcgggcggcgtgcacgggccggccctgtggtacctcgccccgctcggcctgctcgccccgatctcctggctgatctacccggcggtccgcgactggccgcacctgtcggtcaccgcgatcgtgatgccgccgctcggactgatgttcgccctggccacccgcgcccagctccggcacgtcgaccaccccccggtccgccgggtcggcccgccctgggtgcagcgctggcgccgggtcagcgtggttccggtcgccgccgtcgtcgtcaccgtcggcatgctcgtcttcgtcaccctgcacctcggcttcctcccgcccggcctggccggcggctcggtggcgctgaccaccctggtggtgatccgccagctgaccgcgctgtccgacaacacggtgctggtcgaccggctggaggagcaggccaaccacgacgatctgaccggcctgccgaaccgccgcatgttcagtgcgaccctgcaggaccggaccgacccggtcaccgtggcggtctgcgacctggacggcttcggcaccctcaacgaccggctcggcgacgcccgcggcgacgccctgctgcgcgcggcggccgcccgcatcaccgcaaccttcgggccggacgcggtcgtcgcccgcctgctcggcgacgaattcggcatcctgctccccaccggcgcggtcctcccggccaccgggctgcccggctccggacccccggccccgctcgcctcgaccaccggcctgcccggctccggatcgctgggtgagcggctggtccgggcgttccggctgccgctgcaggtggacggccacgacctgctggtcacggtgaccgtcggggtggccgccggccgcgacgacgaggtccccgacctgctgcgccgggccgagctcgcgctcaaggccgccaagcgggccggtgccaaccggcacaccgagcacaccgacgagatggacagcaccgcccagcacgacgccgacctggccgccgcgctgcgccgcggtctggacaggggcgagttccgcctggtctaccagccgatcgtcgagctgcccggcggccggatcaccggcgtcgaggcgctggtccgctggcacccggcggacggcccgccggtctccccggccgagttcatcccggtcgccgaacagaccggcctgatcctcgacctcggcctctgggtgatcgagaccgcctgcgcggacgccgcccgctggcagctccggcacggcgtcgacgcgccccgggtcaacatcaacgtctcggcccgtcagctgctcgacccggacctgcccgaccaggtcgccgccacgatggcccgctaccacctggaccccgacaagatcaccctggagatcaccgaaaccgccgtgttcggcggcggcgccgccctgaacaccgtccgcgacctgcgcgacctgggcgtcggggtggccctcgacgacttcggcaccggccagagctcgctcaccctgctgcgcacctgcccggtcaccaccctcaaggtcgacaagtcgttcatcgacgaactcaacggcaccgccgaacaggaggcgatcgccacctcgctgagcacgatcgccgccacgctcggcctgcgcgcggtcgccgagggcgtcgaaacccgcgaacaggccatccgcctggaggcgctgggctaccgctacgcccagggctactacttcgccaagcccggacccgccgccctgatcgacgccgccctcgaccacaccccggccacgatctgagtcccgccggcggaccggtcccggccgcctgaccccgcggtggcccggcgagccggagatcgaggcagcggattctggcgatgagttcgactcgcggccccggcgtgctcagcgcccgaggccccgcggtggtgcccggacgtgcgacaccaccacgggggcggccggtcagacggtggcgcggtcgcggatggcgtggccgacctcggcgcgcagggcggcgaactccggcgagccgcgcagctcgtcggccgcgaccccggtgcggggcagggcgatcggcaggtcgagggcgatctgcccgggccgcggggtgaggaccacgacccggctgcccaggaagaccgcctcgtccacgctgtgcgtcacgaacacgcaggtccgcccggattcggcgctcaccttgcgcaggtcggcctgcaggcgttcccgggtgagcgcgtcgagtgccgcgaacggctcgtcgagcagcagcagcgggttgtcgacggcgagggcgcgggcgatcgcgacccgctgctgctggccgccggagatctgccaggtgcgccggttggcgacgtcgtgcaggccgacccgttccagcagttcgtcgatccggccgccggtggccggctgcccggcgtatctcagggcgagcgcgatgttgccgccgacggtcttccacgggaacaggcggggctgctggaagaccaggccggcgccgcgcccgggcaccggtggcgacccggcggtccgcaccgtgccggaggtgggctgctcgaagccggcgatgagccgcagcagcgtgctcttgccgcagccggacgccccgaccagcaccaggaactcaccggccggcacggtcaggtcgaccggcccgaccgcggtgacgtccccgtaggcatgcgtcaccgcgtcgagccgcacggccgcggccccggcgccggagacagcggcggtggagccggcggcgagaccgatgtcagccgagggcactgggcagacccttcacatagatcgccttctgcgccgcgtcgaggctcggcaccgcgtcgatcttctgctgcgacttgaggaactcggccgcgctcaccaggttgtccgcgatcttgcccaccttgccgtcggtgcccagccagtccggcgacgagatgtccgccggcttgagaaacacgccctgctgcagctggtgcgcggcgtcgtcggcggacaggttgagttcggcgccgaccgccttggccgccgcggccgggtcggtggcgatggtgttcagcgcctgcgcctcgaccttgcgccaggcgtcgaccgcctccgggtgggctccggcgaacggcgtcgacaccacgcccaggtccagcgtcggcttgccggcggtggccagctggcgactgctgatcagcaccttgccggtcttcttgatctcgtcgagggacggcagccaggtgtacgccgcgtccagatcgccgcgggtccacgcggcctggatgtcctgcggctccaggtcgacgatggtcacctcggactccttgaccccggcctggtcgagcgcggcgagcaggctgtagtgcgaggtggacgcgaacggggtggcgaccttcctgccgcgcagcccggccacgtcggtgatcccggtgccgttgcgggcgaccagcgcctcgttgtcgccggccacgtcgagcacgaaggcgacctggtaggggatgttcagcggcgcggacagcccgcgggcgaccgggctggagccgatcgcggcgatgtcgacgctcttggcgacgaacgccgtgttgatcgacgccccggagtcgaacttcgtccaggtgatcttgtagtcgggcagcgccttctccagcagcccctggttcttgacgatcaggtcgccgctggggaacgcctggtaggcgatgcggatggccttcttggaggcgtcgccgcccccgctggcggcgccgccgctgccgcaggcggcgaccagcagcagggacagggcggaggcggcagcgagcagtctcttcatggggaacgttccttttagctaatgccccgccacgggatcagccgttgttcggctacccgcagcagggcgtcgatgagcaggccggagaggccgatggcgaaaagtccgagcacgaccacgtcggtctgcgagtagcgctgcgcgtcgcggatcatgccgccgatcccgggcaccccgttgatcgtctcggcggcgaccaccgaggagtatgcgacgccgaccgcgagccggatgccggtgaagatctccggcagcgcgctgggcagcaccacgtcgcggatcgactgccagcggccggcgccgagcgcgcgggccgcctcgatcagtccggccggcgcgccgtgcaccgcggcggcggtggcgaccgcgaccgggggcagcgcggcgatcgagagcagccacagcttcggggtctcgtcgatgccgaaccagatgatgaacaggctgaagtaggcgagcggcggcagcgcccggacgaaggtgaccaccggctcggcgatcacccgcagccagccgaccgtgccgaggagcacgccgatcagcaggccgccggcgatgccgatggccgagccgatgacgatccgccggaggctgacgccgaggtgttcgatgagcaggtggccgctgtatccacggacgccgtcgtgcacggtggaggtgaggatcagctggtgccagacggcgccgggcgacgggatgaaggccgggttgttcagcacccgggccgcgatctcccacagcaggcccagcgcgaccagagcgaccagccggagaacgaggcggcggcgcagtccgccaccgggcgcgagcgccgtggtggcgaccggcgcggtggcgccggcaggagcgagcaaggtggtcacggatatctccaggcagaggcatgtggcaatgcctggtattcctatcgtaccgatgggctttatcgcaataccggtcccatggggtggcggtaacaagctcgtaaaacatattcgctcgataggacttgtgggttaccgccatggaaacctagcgtcagcgtcgtgagcgtcctctccccaccgcgtccgaccgcacaggccggcgacgacacccgcgtggtgcccgctcggcacccctggcgctgggccggagccgccctggtgctggtcctgctcgcccagttcgtccacggtctggccaccaaccccggctgggagtggcacaccttcaccggctacatcttcgagaagtcggtgctgcacgccctgctggtcaccctcgagctgaccatcgcgggcgcggcactcggcttcctcggcggcatcccactggccgccatgcgcctgtcacccagcccgatcctgcgcaccgtcagctggacctacacctgggtgttccggtccgtgccgctgatcgtgcagctgctgttctgggccaacctgggctacctctacgagaaactgcagttcgggctgccgttcgggcccggctggtcgttcgccaccaaggacctgatcggttcgttcggcgccgccctgctcggcctggcgctgcacgaggcggcgttcgccggcgagatcatccgctccggcctgctcagcgtcgaccagggccagcacgaggcggctgcggcactcggcctgccccggcaccggcagttcttccggatcgtgctgccgcaggcgatgcgggccatcctgccgaacgccgccaacctgctggtcgacctgctcaagagcacgtcgatcgtgtacgtgctggccatcggcgagctgttctaccaggtgcaggtcgtctacggccgcaacgggcgggtggtgccgctgctgatggtcgccaccgtctggtacgtggtgctgaccgcgctgctgtcgatcctgcagttctacgtggagcgctatttcgcccgcggcgccgtgcggaccctgccgcccaccccgttccagcgactcaaggcggcgatcaagcgatgagcacccccgtggtcgagctcaccggcgtgcacaagtcgttcggcaccctcgaggtgctgcgcggcatcgacctgaccgcgcaggccggcacggtgaccgtgatcctcggcccgtccggctccggcaagtccaccctgctgcgcagcatcaaccacctcgagaaggtggaccgcggccgggtccgggtcgacggcgagctgatcggttaccgcgaggccggcgagaagctgcacgaactcggcgagcggcagatcctcaagcagcgcgcccggatcggcttcgtgttccagaacttcaacctgttcccacacctcacggccctggagaacgtggcggaggcgccgatctcggcgctgaagaagaacagggcgtcgacgtacgcgcaggcccgcgccctgctcgaccgggtgggcctggccgacaaggcggacgtctatccccggcagctctccggcggccagcagcagcgggtggcgatcgcccgcgcgctggccctggagccgcggctgatcctgttcgacgagccgacctcggcgctcgacccggaactggtcggcgaggtgctcgacgtgctgcgcgacctggccgcggcgggcaccacgatgatcgtggtgacccacgagatcggcttcgcccgggaggccgccgacaccgtcatcttcatcgacgagggccggatcgtcgaacagggcccgccggccgaggtcctcgacaacccccgccacgagcggaccaaagcattcctctcggcagttctcgtctaacaaacggagtcatccatgcgtacaagagtcgccatcgtttttgccgcagtggcggcgctgggcctgaccgcctgcgccgcgccggacgagtccccggcggccgcggccgccgccccgggcgcgtcggccgggcccggcatcaacatcagccccgaccagaaccggatcgtcccggccaaggacgacgcgatcgcggcactcgtcccggcggacatccgggccaccggcaagctgacgatcggcgtgggcgcggccggttccggctcgccgccgctggcgttcaccgcgaccgacaacaagacgctgatcggcaacgagccggacatcgcctacgcggtcgccggtgtcctcggcctgcagccggagatcgagaacacctcctgggagaacctgttcatcggcctggacagcgccaagtacaacgtcggcatctccaacatcacggtcaccgaggagcgcaaggagaagtacgacttcgccacctaccgcctggacaacctggccttcgcggcgaagaagggcagcggctggaagatcgccggcccggccgacgtggccggcaagacgatcgcggtgagctccgggaccaaccaggagaagatcctggtcgagtggagcaaggaggccgagaagcagggcctcaagccggtcaacatcaagtactaccagaccaaccaggccacctacctggcgctgggctccgggcagatcgacgcctacctcggcccgaacccgagcgtcgcctaccaggtcgcggtcgatggcaaactggagatcgtgggcacctactcgggcgccggcgccaccctgcagggcaagatcgcactgaccaccaagaaggacgacggcctggtcaaggcgctcggcgcggcggtcaacaagctgatcgagaccggcgactacaccaggatcctgcagcgctggaacctgaccaacgaggcggtcgacaagtccgagatcaacccgcagggtctgcccaaggcgaacaagtgacctccgcggtcaccgacgaccgggtgctggacaacccggcgtggctcgccctgcacggcgaccacgcccggttcgcccaggtccacggcctggcagcgcgctaccacagtgacgtggcaccgttccacgcgctgggcgcgccggaggacccgcgggcctggtccgacctgaacgccttcgtcccgcccggcgagccggtgatgctcgccgggctgggcgcccggcccggccccggctgggaaatcgaccgcagcatcgacggcgttcagctggtcgacgtgtcactgcgcgccgaaccggacccgaacctggtcgtgctcaccccggacgacgtgccggagatcctcgacctgatcgcccgcacccagcccggcccgtacctgcggcgcaccatcgaactcggcacctacctcggcttccgggacgagggccggctggtcgcgatggccggcgaacgcctgcggccaccgggctggacggagatcagcgcggtctgcacggacgccgcctaccgcggccgcggcctggccacccggctggtccgcgcggtggcggccggcatccgcgcccgcggcgccaccccgttcctgcacaccggggcggccaacacgaccgcgatccgcctctacgaggcgatcggtttccagctacgccgcacggtggacttcaccgcgtaccgccgagctggctcctgaccgcccgcaggttgtccgcggtcttctgcgcggccacccgcagccgggcgcgctcggcctcggtcggcgcctgagccagccactcctggcggtgggcgagacattccgcgagcagctgctccgcccggaacgtctcgcccatctcggagcagaccaccgccagcgactcctgagaggtcagggtggccatcgccgactcgcccagggtggccagccgcgcctcgtaggcgatcttcaacgcgttgtacgcggcccgcagattgtcccgcgcgaagtggaccacgccgaggttgtgctgggtggtcagggtcagcgggtcgtcctcgccgagcaggaggcggcgctgctccagcacccgctcgtagatctcctgcgccagcggcagcgtgtccgggtcggtcatccggccggcgatctcggccatcacgctgagcgtcctgaggtgcgcgtccgggctcggccgcggcggtggcgccggccgttggttggcccggtggctgcgctcccgtgcggcgttctggacgatccgccgccacgcttcgtccagcgcctccagcagttcctcccgatcgacgccgcacgcttgcgccagcgggcgcagcagctggccgtcgatgctcgagtagcgcccggtcagcagatcgttcacccgggtcttggagagtcccggggttcccaccgccttctccgccacctgccgctgcgagcggttgcgctcggtgcggtaccagttcagggcggtgagaagctcctcggcggtccgggcgtcccggaaccgctgcagcagggcgtcgtccgccgggcgcggcgtgctcatgcggcgctgtcccggacgtgtcccgtccactgtccacgagcccgcggggacggccccggacacgtgtccggcggccctggacggccggttccggccaccggccacgtccatgtcccggcctctgccggccaccccgggaacgggcgcacgctggctctcatcccggcaggcgcacggcacggaaaggacggcaccgcggtgatcgagctcttcatctcgtccctcatgaccaccgagcacctcgcactcctggaggcgctcaccgtgatcctcaagttcctggccgccctgtgcggcggcgtggcgagtgtggtcctgctcgtgacccggatccgccgctggacgcggcggcgccggcggaccgaccggacggcccgctgacccacagtctgcacaccgccccgccggccacccggccgacggggcgtcatccttcaggacagtggacggtcgcctgcgggaccgaagacaccggaccggatcgcggagaggaaaccggcccactggccggcggtgcaggtgatcgagccggccgacggatccttgctgtcccggatcagcacggtgtccccgacggtcgcgacctcgacacagttcccggtcccgcaacgggcgctcctgcgccacacagtgtgcctcggcgacgtgtcgcccaagacgcctccctggtcggacggatctttatcacccgcgtcggcgacgccccagagtgtagattctcctcgatccccgggccagtctgatcaggaccgtggaactgtaaggaatatgcaccccggatcggattagtccgctcgggtcacgattcccggatgcccccggcggttcttgtacgatccgagtcaccaggacgatccggccgcaggcagcggtcccgcacgatgacgaggtggctgtgcgacctgctccttccctcgggcaagcgcctgttcgaccgagcgagccacccgccgaccccgcctccccgatccgcctcgcggtttacgccatctgcaccggggcgatcgctctcgggtcgggccgggcattcggatccacattcttcacgagcacctcggcgagagccgcggcgctcgccgtcatcgccttaccggtcagtgtcgccgccggcctcgcctgcgatccggtcctgcggcggtggcagcagttcatcgatggtcgtcgcggtcccgaggcctgacccgggcccgcatcagccgggccgccgcccacgtcgacagcaccaccatcgcggccaccgcgacgctgagcatttgcacgtcccgcagcagcagggcgccgatcagcaccagcgaccacaccagcagcagcgcccggacgaagttctcgggtttcgtcacgatgccggtcgccaggtccagggcggcatgcagcacccccacgaggccaccaccccgccggcggccgcgcggcgcgcgcgggtcgatgtgcagttcgcggtcgatctcggtcaccggctcgcgcctcccctcccctgatcagggcgcgtgtgacaccaccctcagccgagggcggcaagcgcgccgtccagcagcgcgtccaacctgtccgctccgtgcgcggcggcccgcagctcctcgaagttggcggcgaagcgggccagcagccgctcgtcgtgcttggtcaggaactcgccggccgcgttctccaggtagagcaacgggcggtcctcggcatccgggaactccaggatcacgaaggggccggccatcgccacgtgggcgccggtcgagaacggcagcacccgcaggtcgacccgggggtgccggctcatcttgcgcaggtgctcaagctgctggcgcatcaccgcgccgccgccgaccacccggcgcagcaccgcctcgtccagcacgaaccgggcctgcgagatgcccccctcggcgaagacctgctggcgcatctcccgcaggctgacgatccggcggacctgctccaggacggcctcccgctcgctctcggcacaggagtcggcgtagagcagcttgcgcaccacggtctcggcgtactcccgggtctgcagcaggccggggacgaacgagttctcgaactcgtactcccgatcggcgatgagctcgctctccagaaaatcccggaaatccttcgaatggatgtcactcatctccggcaggctccgctgccgcgccgcgtcggccatcgccgtcaactcctccgcgagctggtcgtcgacctcgtagacgccgagaaggaccttgagatcggcgtacgagatgctgttctcgccggtctcgatccgatgcaccttggactgcgaccagcgcatccgctcggccacctgcgcctgggtgagcccccgctccagccggatccggtagagccgtctggtcagtcgtttccgttccagtgccgccgctcgccgctcccctacgcccataccggccccactactctccgttaaaactgtccgagttcaaccatcggtgaattgagcctagcgcagtattcacaacgctgcctgcagtctgcatatgcacatcgcatgtcgcagaagcctctttcacgtgccggtttaacaatcgaaatcctgggtaaaaaggcaatcttttgggcggcgccatgaacatccccgaaacggcgatcatcacagtgagtagacggcggcctattccaccgcggccgggtgagtgccacgctgcgggaccaggtccagcaggcagtgtcggcaggcctggaccgcgggggtcagcggccggtcccggtggtggatcaccccgatcggcggatgggccggcggcgcgtgcaggtggcggaccgtgatggccgggccctgctcctgttcggccaccgagcgggccagcagcgccaccccgaggccggcggcgaccagctcccggatgctgcgcggactgtgcgtctcgaattgcacccggggtgcgaagccggcggtgcgggccgcgtcgtcgaggatccagcgcaggccgctgccctcggacaggcagacgaacggctcgtcgcggaactcgcccagggtgagccggccggtgccgctgagcggatgcccgaccggcagggccagcaccagctgttcgtcggcgagcggcagagcttcgaagcggggtggcaggtcggcgtgcaccggcccgacgaccaggtccaactcgccgctgtcgagggcgccgagcagcccggtgaccaggccggaacgcagccgcagggcgatgccgggaaaccggtcgtggaagcgggcgagggcggccggcaggtcgtagttgccgagcaccgaggtggcgccgacggtgacccggccggtgaccaccgtggtgatctcgcccatctcgaggcgggcgccgtccaactcggcgaggatgcggcgggcccgggcgacgaacatctcgccggccggagtgagcgcgacccgccgggtggtacgggcgaacagggtcacgccgagctcggcctccagggcccggatctgtgcggagaccgccgactgggcgacgtgcagacgttccgccgcccgggtgaacccgccgtaccgggccaccgcctccacgtagctgagttgtcgaagctccacccgttcatcgtggcgcacgatgaatgccatcgggaacgtgtcttggacatatcaatcgtcggataccagtctggggtcatgcccaccgcgaagctcggcaccctgacctgctcggcgatcggcctcggctgcatggggttctcccaggcgtacgggccggccgacgacgattcctcgatcctcaccatacgggcggcgctggagcacggggtgaccttgctggacaccgcgatgagttacggcgccgggcacaacgagcggctggtcggccgggccgtcgccggccgccgcgaccgggtgctgctggccaccaagttcggcatcgtccgcggcgacgacggcgtgcgcctcgacgcccacccggaccgggtcgccggctactgcgaagcgtcgctgcgccggctcggcaccgacgtgatcgacctgtactacctgcaccgcgccgacccgcgggtgccgatcgcggacacggtcggcgcgatggctgagctggtcgccgccggcaaggtgcgccacctgggcctgtccgaggtgggtccggagcggttcgccgcggcccgcgcggtgcacccgatcgcggcggtgcagacggagtggtccctggcctggcgcgagccggaggacgacatcgtcccggcggcccgcgcgggcggcgccggcctggtcgcctacagcccgctcggccgcggcctgctcaccggcgcgctgccggccggcccgttcgcccccggcgacttccgggccggcgacccgcgcttcgccggccccgagctcaagggcaaccgcacgctggtcgaggctctccgggaggtggcccggtcgtacgacgtgacggtcggccagctcgccctcgcctggctgcacgcccagggtgacgacgtggtcccgatccccggcacccgcgatccggcccgggtcgccgagaacgcggccgccgcccggctcaccctcacgcccgccgacctggccaccctggagtcggtcgccccgcgcaccgcctggcggggcgaccgccgctcgttcgccgcgcacggcaccacccgcacccggtagccgtcacgaggtggcgatgagccgccgtaccacgtcgtaggccggtttcggacgatagtcgtcgcgcagcagcccgaacccgttctgccagccgccgtcgctgatcccgtcccggagcgagaacagttcgtacacgctgacctcaccggtcgcgagcaccgcctcggcgacggcccgcagcacgcgcgcctgcttcgcctcgtcccgggcacggccggtgggccagccggtctcggtcacgtgcagcggtgtgcgcccggagatcccggcgtcgcgggtgacccggcgcagagtccggacgaggaaccgcacgccggccccgatgtcgtcctccgggatcggacggaagacgtcggggaacatgtccaggccgacgaagtcgagccgagcggtcgagaccggccccagggcgccggtcatcctggcccagaacgccgggtcggcgacgccggcgccgttcacgccgatcgccacggccgcgccgagacgatcgcgttcgtcgagcccggcggccacgccggcggcgaccgcctcgaagcaaccgggaaagccaccgtccagcggagcgggcacattgagctcctcgcccacctgcacctttccgccaccccacccggcgacgtcgcgaaccgcccggcggacgaactccgcgtagcccgccgggtcgggcgcggtggcgcgatagcaggccaccaggtcgatcagccgcccgcgcccggtgtaccgcccggggtcggccggcgccgggtccccgcccggttccgaggcggccgcgccccggtagtgccgatagcagcggatgtagaacgacgccgcgccaccctgcagccggtcgagggcgacgctcgtgcgcgccacgtcctccggcggtgtcgccagcggcgtcaggtccaccaggtcagccgcgaccactccgggccagatgccgtaccacacggcgccctcctcactagccgtatacggataggtcgtcaccatagccgtatacgggtgacttcgctaccgtggaccgggtgccgaccaacgcgctcgcgaacccgctcgtgctgcccatcctcgggctgctggccgagcgcccccggcacgcctacgccctgttcagcgagctgcggtcgcgctacacctatctcggcgtccggaactcgaccgtctacacgctgctgaacacgctcgtcgacgccggctggctgcgcccgacgccggtcgggaccgatcggcaggagttccggctgacccccgcggggcggcaggccctggccgagcgggtggagcgggagatccgggacggcgccctcggcgaccgcaccgccttcctgaccgcgctggcctacctcgggatcctgaccccggatgcggcggctgcgaccctggagatccgggccggccgcgtccaccatgaacaggaacggctcgcgcacgctctcgacgcggccacgggtgtcccggaactgcacatgatcgagatccacttctaccgcgaccagcttcagcgggagcacgcctggctggacgcgaccgcccggcgcacccgctccggggccctcgcgtggccgggtcaggaaagctgaggctcggcggccagatcgccggcgtggccggtctcgctggtggcggtcagcgccgcggcgaacaggaccagctgattgaccgcgttgaggaagaccagcaggccgaccgatccggcgaccaggtggtaggtgggattcgtctgggtgcgctcgacgtagacgcggcctagcgtggtgaggaattcgaatccggccgccaccagcacggccgggccgagcacgcgacgccacggcatccggatccggggcagcccggtcagcagggcggtggccagcagggcgttcaccgtcaggccggagagcagcccgacggccgacaccaccacccgcgacggcgtggtgccggcgccggcggcgacgatcacccggttcacgatcaccgacgtctcgtaggcgatcgcgagcgacccgctcagcagcacccccaggccggccagcaccagcatgtcgacgaggatgcggacgacgagccgccccgggtactccggcaaccgccacatccggcggatcgacgagcgcagcacgtccacccagaaccagccggagaccggaaggccgatgaaggcgatgacgccgacggtgttgcgggcgtcgcgaaacgactgcacgtcgacgtggggcaggttctgtgcggcgtatcgctgcgccgcgtgcagtaccgcctggtcgtcgagcacgaaaccgaagatcgcgaagccgagcagtccgagcgagaaggtggcgaagaaggagtagtaggtgaccgccgcggcgagccggcccccgtccgcctcgtcgtaccgcttcccggcccggaccaggtgcgcccaccaaccggcacggcggcccgactgccaccaacgtgtttcgctcacggacaccccgttacccgatcgccgggttctctagagctgcagctcgtgcaggtaccgctcggcccagtcgcgcaggccgcgcagcggggtgaccaggctgcggccgaccgcggtcagctcatattcgacgtgcagcgggaccgcgggatagacggtgcgggtgagcaggccggcatcctccatccggcgcagcgtctgggtgaggaccttggggctgatcccctccaggtgccgctgcagcacaccgaagcgcagcgggccgccctcgagcgcgccgaccgccagggtcgtccacttgttggcgatcaggtcgagcagcccccggcaggggcagagctcggcgaagacgtcgtgcttgtcgtgctcgccggtcgggcacaccgcggtcatcagcctggcctccttggttaccaaaggatagtagtcgcccttgcgggtaactaccaccctgcggatagcttcggagccctgacccagagagaaagaaggtcgtcatgcgcgtcgtcacgcagcacgagttcggggatccgtcggtcctgcacctggccgaggcgccgaagccccgtccgctgcccaccgaggtgctggtccgggtggtcgcggccggggtcaatccggtcgaccacaagacccgggagggcgccggcatggccggcgtgctcggcgcgccaccgttcatcctgggctgggacgtctccggggtggtcgaggagaccggcttcggcgtgcacaccctgcggcccggtgacgaggtgtacggcatgccgtggttcccgcggcaggccggcgcgtacgccgagtacgtgaccgccccgtcgcgccagttcgcccgcaagcccgcgaacctgtcgcacgtcgaggcggccggggtgccgctggccgcgctcaccgcgtggcaggcgctgaccgacgcgaccacggtcaccgccggtcagcgggtgctgatccacgcggcggccggtggggtcggccacttcgccgtgcagttcgcccggcatctcggggcgcacgtcatcggcaccgcccgcgcggcgcgccacgactggctgcgcgagctgggcgccgacgaggtgatcgactacacgaccacccggttcgaggacgccgtcaaggaggccgacctggtgctggacctggtcggcgacgaggacaccgggctgcgttcggtgaccgcgctggcaccgggcgggctgctgatcgcggtgccgggcggcgtggcgccggccgtcgcgcgggccgccgccgagcagggcaagcgcgccgtgccgttcctggtggagccggacggcgcggcgctgggcgcgatcgccgggctgatcgaggccggccacgtgcgggtggaggtggccggggtactgccgctggccgaggcgggagaggcacaccgccgcctggccaccggccgcacccgcggcaagctcgtcctggaggtctagccggcccactccttggccagcagttcgaaggagcggacccggtccgcgtggtcgtgggtgatcgtggtcaccagcagttcgtcggcgccggtcacccggcgcagcgtgtccagcctgccggcgacggtggccggcgagccgacgaactgggtggcgacccggtcctcgaccagcttgcggtcgtggtcggtccactcgaacgcggccgcctccgccgggctggggaacgggatcgccccggcgccggtgcggatgctgcggacccacagcgggtacggcgcggccagccggcgggcggtctcgtcgtcctcggcgacgaccacgtcggcggagaccaccaggtacggctcggccagggcggccgacgggcggaacgccgcccggtaggccgccgccgcctccagcaccttggccggggccacgtggtaattggcgacgaaaggcaggccccgggcgccggccgtgcgggcgctctcgccgccgctgctgcccagcagccacagctggacgtcggcgccggcgccgggcaccgcggtgacctcggcgcctttaccgtcgccgtacgggccggcgagcaggccggtgatctggtcgaggatctcgccgaggccgagcggctcggcgccgggctgctgcaggagccggccgatcagggcgctgcgttcggaggcgaagatcggcgcccaggagaacggcttcgggatcagcagcccgtcgacgacggtcacctcctcagcggtctcttccgcagagccggcgagggcttccttcttggcctgcccggagcggcccaggcccaggtcgaaccgacccgggtagagcgcgtccagcagcccgaactgctccacgatggacagtgcggtctggtggccggtctgcaccgcgccggagccgagccggatccgggaggtgaccgcggcgatctgaccgagcagcagggccggctgtgcggaggcgacgcccggggtgaagtggtgttcggcgacccagtaccggtggtagccgaactgttcggcgctgcgcgccaggtccagggtgcggcgcagggcgtcgccgacgtcgccgccggagaccagcggggccaggtccaggattgacaggggtacgggcatcggcggttaccaccctttcagctggcgcagcacgggcgcgacctcactggcgaacagttccaggctggcgcgctgttgtttctcggtcagaccttcggtgtcggcggccaggtgggtcacctcgtggccgaaccgttcgtggtagcggtgcaccttgtcgatgatctgctgggggctgccgatcagcgccgagctgcgctcgatcgcgtcctcgatggtggggaagaccggctcgacgccgaccttgcggaactggtcgatccgggcctgccagatcggccggtacacgtcgagcgcctcctgcgaggtgcgggtgacgtagaagccggcgctgcccgccccgatccggatcttcgccgggtcatggccgtggaaggcccacctctcccgatagaaatcaatcaattgggcgtacgggtcgacgggattggtgacattggcggagaacagcggatccccgtaccgcgccgccagctcgaccgaggccctgctggtggcgctgccgtgccacacggtgatcggctgctgcagcgggcgcggccaggtctccgcatcggtgagcgagggccggaacctaccctcccaggtcactttcggttcgcgccagagccggcggaacagttcgtagctctcccgctggcgctcccactggtcgtcgacggtgacgtggaacagctgggcctgcgcggcgccgttgcccttgccgacgatcagctgcaggcgcccgccggacaggttgtccagggtgctgtagtcctcgaaggcgcgcaccgggtcgagcaggctgagcgtggtcaccccggtccacagctcgatcgtcgaggtcttcgcggcgatgtgactgagcacgaccggcggcgacgaggacaggaagggccgctcgtgccgctccccgacggcgaagccgtcatagccgagctgttcgccgagcacggccgcgtcgaccacctcgcgcagccgctgcgccgggctcttctcccggtcgaagtgcgtgatcaggctgagcagcaggaacttcacgccagccccaggtgcccgcgcagcgtggtggtctcgtactcggtgcggaacacgccgcgttcctgcagcagcgggaccacctggtcgacgaagtcgtcgagcccgcccggggtcaggtgggagaccaggatgaagccgtcgcaggcctcggtctgcacgtactcgttgagttcggtggcgatccggtcggcggtgccgatgaagttctgccggccggtcacctcgatcaccaggtcgcggatcgacagcttcttcgcctcggccagcgcccgccactcgttggcggtcttgatccggtcggggaacatcccggcccggcccttgacgatcgagtcgtcctcgtcgaggaccgggtcggcggtgggtagcggcccctccgggtcgtacgccgacaggtcccggttccacagttgttccagcaacaggatcgcggtctgtgggctgacctgctggcgccggatgtggtgggccttctcctgggcgtcggcgtcggtgtcgcccagcacgtaggagacgcccgggatgatcttcagtgagtcccgttcccggccgtatcggcccagccggtccttgacgtcgcggtagaactgccgcgcgtcgtcgagcttgtggtgccgggagaagatcgcgtcggcgtgccgggcggccagctcgcggccctcgtcggagtcgccggcctgcaggatcaccgggtgaccctgcgggctgcgcggcaccccgaagcggccctcgatgccgaactgcgagctgtggatggcgaagtcgccgccgtcggagtcccacagggtgcgggccgcttcgatgaattcgccggcccgcacgtaccggtcggcgtggtcgaggaagccgccgcgccggaagttctcgccgtagaaggcgccgtgcgaggtgaccacgttccacgcggcccggccgccggacaggtggtccagggtggccagttgccgggccagttcgtagggctcgtggaaggtggcgttgagcgtgccggccaggccgaggtgctcggtgaccgcggccagggcggtgagcacggtcagcgtgtccgggcggccgaccacgtccaggtcgtggatcagcccgcgctgctcgcgcagccgcagcccctcggcgaggaagaagaagtcgaacctgccgcgctcggcggtgcgggccaggtgttcgaacgaggcgaagtcgatctggctgccggagcgggggtcgctccagacggtggtgttgttcacgcccgggaagtgggcggcgaggatgatctgcttaggcacgggcggcctcctggaagtggttgacggcctgcggcagcccgaggcgttcgcgcagcgtggtggcggtcgagggggtgaagatgccccggtcgcggagttcggggaccaggtcgcgggtgatccgggtgagcgcgtccggggtggccggcagcagccggaccccggcgatcccggccggttcccacgccgcgatccggccggccagttcggccgggccggcgtcggcggtgacctccaggtcggcgaagaccagcttgccgggcagccgggtgacgatcccggcggcctcgtcgagggtctgcggggtcacgaagtagacgtcgacgtcgaggcgctccgcgacctgggcggtgtgggtgagcgcggcgatcaccggctggccctgcggcgggcgcggcacgatcgacgggcccttgaccgagaagtacgcgccggtgaagtcgaggtagtgcagtttctcccgatcgatgaaccggccggtggcgacgtccttgatgatcgcgtcgtcctcccagctgtcccagagccggcggaccacggtgatcgcgtcggccgcctcggcgaacaggtcgtcgaagccgagcggcgcacggcggccgagcagggccgcctcggccgggtcggacgagacccgcacctgccagccggcccgcccccggctcacgtgatcgagcgtggccagcgcggtggacaggtggaacggctcggtgtgcgtggtggtggcgaccgggaccaggcccaggtgccgggtgaccggcgcgacccgggcggcgaccaggaccgcgtccgggccgcgccggccgaaccggtcctcgaaggtggcgaagtcgaggcgcgcctcgtcggcctgccgcgccgcggccacccaatccgatgcggcgaacgaatcgccgtcgagcccgacggcaacgtgcagggtcacgggagaacctccagagtgggcacggcggcgagaagctgccgggtgtagtcgtcggtgggctggtcgaaaacggtcttcacgggtccctgctcgacgacccggccgtcccgcatgacgagcacccggtcggccaggtcgcggatcaccccgaggtcgtgcgagatgaacagcagggcggtcccgtcggtctcccggatgtcggcgagcagatcgaggacctgcgcctgcaccgacacgtcgagcgccgagacgggctcgtcgcagatgatcaggctcggtcgcggggcgatggcccgggcgatcgcgacgcgctgccgctgaccgccggagagctgccgcggatagcggtccagcacgtccgcgccgagcccgacgcgctccaggaccggcaccacgtcggcgccgcggggcagcgcctcggcgacgatccggcgcaccgtccagcgcgggtcgaaggccgacagcgggtcctgggcgatgaactgcaggcgccggcgcagcgggcgacgggcccgctcgggcaccccactgaaccggctgccctcgaagcggacctggccggaggtgggttcgacgagcccgaacagcagctgggccacggtggtcttgccggagccggactcgccgaccaggccgacgatctcgccgcgggcgatcgtgacgtccacgtcgcggaccaccgcccggtcgccgtacaccttgcgcagcgccctcgcctcggccaccaccggtcccggcgcggtgtccgcggtccgcttccggccgctggcggcggcgatcaactgcctggtgtacgcgtgatcggcgccggtcagcagccgcctcgtcggaccgctctcgacgatccggccgtccttcatcaccagcacccggtcggcgagccgggacaccacggccaggtcgtgactgatcagcagcagggtctcgccggccgcccggcgttcggccagcagggtcaggatctgcgcctgcacggtggcgtcgagcgcggtggtgggctcgtcggcgatgagcagtttcggaccaccggccagggcggtggcgatcagcgcgcgctgccgcagaccgccggagagctggtgcggatactgcgtggcccgccgctcgggctcgggcacgtgcacgtcgcgcaacagccggtgggcctgcgacgtccgtcccgctcgcgaaccctgcccgtggacgcgcagcacctcggcgatctccgcacccaccgtgcgcagcggatcgagcgagaccagcgcgtcctgcagcaccagcccggcgaagccgccgcgcagccggcgccagtcgcgcggcgcgaagcggcgggcgtcccggccgtccacctccagccgggcggcctgcacccgggcgcccggaccggccagtccgagcaggctgcgggcggtcacgctcttgcccgagccggattcaccgacgatcgccacgcactcgccggcctcgatgtcgaagctcaccccacgcaccgcctcgacggtgcgccgcggcaggtggaaggtgaccgtcagatcctcaacgttgatcatgctgttccttcgcggggccgccggtcgccctggttcatgccgtctcccggccttcgaaacgccgctgcaggaagcggccgacgacggtgagcgagacgatcgtggcggtgacgaccaggcccggcaggatcgacgcccaccaggcgatgtgcaggtagccgcggccgtcggagatcatcgcgccccattccggggagggcggctgtggtcccatgccgagaaagctcagcccggccgccagcagcaccgtctcgccgaggccgatcaccgccagcaccgggatcggacccagcacgttgggcagcacgtgccggatcaccagccggggccgggaggcgccgaaggcgaccgcgtgggtgacgtaggcggcgcgacgcaccacgaacgtctgcgcccgcaccacccgggcgaagtgcgggatcagcgacaccccgatcgccacgatcaggctggccgtgccggtcccggcgatcgtgatgaacagcagcgcgagcagcaccagcggaaacgccgacagcgcgtcgaaggagcggctcagcgcctcgtcggcgacccggtggctgagcccggcgagcagaccgagcaggatgccggcgccgaccgcgatcagggtggcggtcaccccgatcgacagcgagtgccgggcgccgtgcaccacccgggcgaacacgtcgcggcccagctgatcggtgccgaaccagtgccggccggacggcgcctgcagagtgtgcagcgggtcggcggccagcgggtcgccggcgaacagggccggggccaccgcggcggtcagggccagcagcaggaacaccacggccagggcgacccccggccggggcgcccgcaggccggccggccggaccgcccggggccgggtcagcgcgacggtcatcgtcagctccttcgcagccggggatcgatgagcaggtacgccaggtcggtcagcgtgttgatggcgacgaacaccgccgcggacaggatcaccacggcgagcaccacgggcaggtcgctggagttgaccgcgttcacggtgatctggccgatgcccggccggccgaagaccgtctcgatgatcacggtgcccgcgatcagcacgccgaacgaccagctgagcatggtgatggcgggcagcagcgcgtgcttgagcgcgtgccgcaccaggaccgcgctctcccgcaggccgcgggcccgggcggtgaccgcgaacggctcgtcgagggcccggtccaggccgtcgcgcagcacctgggccagggtgccggcgatcggcagccccatggtgatcgccggcagcaccagggcggcggcgtcgcgcgccccggagaccgggaaccagccgagccggaacgagaagacgctgagcagcacgatcccgatcaggaacggcggggtggagaccagcaccagctcggtggtcgagctgagccgacgcacccacggacgccgggcgaccagggccaggaccagcgcgagggtgatcccgaagccggccgcggcggcggccagttgcagggtcggcccgagctcgctgccgatcacgtcggcgaccggccgctgcagcaggtaggagcggcccaggtcaccgtgcagcaggcgccccaggaaatccaggtactgcaccacggccgggctgtccaggtgccactcctggatgatctgcgcgcggatcgccggagtgtcggcgccgtcgccgatgatcgcgtcgaccgcgctgcccggcgccaggagcagcgccaggtaggcggcggtcgcggcggcccagaggaccagcgcgcccgccgccacccggcgcagaatgccgatgatcacttgcggagccagaggttgtacgcgctgcccggaacgcccgcggtcggctcgaagtgcgccccgcccacggtgcccgcggtcgcgatctggtcctgcggcgcgtagagcggcaacaccagcgcctggtcggtgatcaccagcttctgcagggcccggtacgcctgcgcccgcttggccggatcggtggtggcgatgccgtcgtcgagcagcctgtccagctccgggctcttgaagccggtccggttgatcgcgccggtggagtagagcagcaggttgagcgccgcgccggcgtcggtgtcggcccgggagttgtcgaacacctcgtaggcgccgtcggccagcgccttggtggcggtgccctggtcgaccagctgcacctgcaggtcgatgccggcgctctgcttgaccgcggcctgcacggcctgggcgaggacgtcacggcggtcccggacgaacggggcggactgcacgatgcgtaccgtcaatcgctttccgtccttgacccggtagccctcggcgtccctggccgaccagcccgcctggtccagcagctggttggccttggcggcatcgccgccgtaggcgccttcgagggacctgtcgtagaagggactggtcggtccgatcacgctccacgcccgggtcgcggtgttccggtacaccccgcccagcaccgcgggcacgtcgagcgcctcccggaacgcctggcgcaccctgacgtcgtcgaacggcgcgtgcgcggtgttgaagtagtacgcgtacgccgagcccgagttcagcccgcgctgcaacctgaggtccgggttcgccttgatcagcgactcgtcggtggccggcaccccttcgatcacctgggcctggcccgaggtgagcgcgcctacccggaccgaggattccttcaggaaccggtaggtgatctcgttgaggtacgccggtccggtgtgcccggcgttggccggcgcccagttgtagttcgggttcttcgtgaagtgcacctcctggccgggcgtgtagcgatccaggacgaacgggccggtgccggccagctcggggccgccggccttgaggttcttggccgctttcagcgactgcggggagatctgggcgccctgcggcgacgagacgaagtccaggatcagcacgtccggacgcttgagctggaagacgaccgtggccgggtccttgacctcgaccttgtccaggttgcgtagctgcacggcggcgacgcccggcgcgtaccccggggtcagcagttgatcgatgttggccttcaccgcggcggcgtcgaacttggtgccgtccgagaagctggcatcggtgcgcagcttgaaggtgtacgtcctgccgtccggcgacacctcgtagccggtggccagccagggcaggtagccgcccttgtcgtcgtgggtgagcagggcctcgaaactgttccagaccagcaggcgagccttggcctgggcgtactggtgggggttgaaggtgatcggctcggtctcgacggcccaggtcagcgcaccgccgctgaccggcttcccggcgtcggcggtgctgcccgaggtacccgaggaacaaccggcgagcaacagcagggtggtgacggtcgcgatggtcatgcggcgcatggacgtcctcctctccgtatttcctataggttccataggagaaaggcaaggtgatccgcgtcgtagttgaaccatcctcggcggcaggccgtttcctcagacgtgcaatcgaatgacctcgccgacgaacagcccccggccgcgcccgaagcctcgcgcctgcggcggctcctgcgccggtccgccggcctgcggcagttcctgcgccggccggcgatcagccacggcgtcaccgtcctggcctgcctgatcgtcttcgtggagctgctcttcccgaacatcctcaaccggctcaacccgggcagcttcctgcgcatcccgatcgaggccgcgatcggcatcgccgtgctggtcgtgctgcccgggcgcccccggcggatcgccgccgtactggccggcgccggcctcggctgggtggtcatcgagaaatgcctggacatcggcttcttccaggtgctcaaccggccgttcgacccggtcctcgactgggtgctcttcgacgacgcgtacgacttcgtggtctccacctacggcaccggcggcgcgatcggcgccgtggccgccctgatcgcgctgatcgccgtgatcctcggcggcaccacctgggcggtgttgcggatcacccggctgctcggccaggaccggcgcaaatcggctttcaccgccggcttcatcgccgtcgcctggggcctggccgtcgccttcggcatccccaccctgctgcccggcgtgccggtcgccgcccgcaccacggtgatgtacgcctgggaccgcgccgggcaggcccgcgccggcatccgcaacgaggccgcgttcagccgcgaggtgcaggtcgacgcgttcaagaacgtcccgtccgaccagttgctcaccggcctggccggcaaggacgtgatgctcaccttcgtggagagctacggccgcaacgcggtcgaggtgcccccgctctccgacggcgtcgacccggtcctcgacaccgccaccgccaagctcaaggcggccggcttcacctcgcgcagcggctggctgacctcacccaccttcggcggcggcagctggctggcccactccaccaccatgtccgggctgtggatcgacaaccagcgccggtaccggaacctgaccgccagcaaccggatcaccctgccgaacctgttccggcaggccggctgggacaccgtcagcgtcatgccgggcgccacccgggcctggccggaaggcaacttctacggcttcaaccggatctgggactcccgcaacctcggctacaacgggccccggttcagctgggccccgatgcccgaccagtacaccctgaagaagttcaacgaggtggagtacgccaagccgggacgccagccgctgttcgtcgagatgccgctggtctccagccacaccccgtgggcaccgatcccgtccttcgtcgactgggaccaggtcggcgacggctcgatctacaacgcgatcgtggccaaccagccgagcaaggcggaaatctggaaggcctccgacacggtgcgccaggaatacggcaagtcgatccagtacacggtcaccacgctgaccgactgggtggccaagtacggcaaggacaacctggtgatgatctacctgggcgaccaccagccgtccccggtggtgaccggcgacaacgccagccacgacgtgccgatcacgatcatcgccaaggaccccgccgtcatcgaccggatcgccggctggggatggaccgacggggtgaagccggccgcgaacgcgccggtgtggccgatgaacgccttccgcgacaagttcctcaccgcgatgggtcccggcggcgccagccactgacccctcgccggtcaccgcgccgtcaccgcagtagcgggcgcagggcgtcgagcaccgcgggatcctcgatcgtcgaggggaccgcgggctcggcgccgtccgcgatcccccgcatggtgccgcgcagaatcttcccggaccgggtcttcggcaacgccgcgaccacgtccacccggcgcagcgcggccaccggaccgatccgtccacgcaccagggcgatcaactccgccgccacaccgtccgccgacgccccggacttgagcaccacgaacgcccgcggcacctgcccccgcaccggatcgtgcacgccgatcaccgcgcactcggccaccgccggatgcccggccagcacctcctccatcgcacccgtcgacagccggtgcccggccacgttgatcacatcgtcggtgcggcccagcacgtacaggtaaccgtcctcgtcgaaccggccgccgtcgccggtcgagaagtttccctggaacgccgacagatacgaccggacataccgctcgtcgtcctgccacagcgtcggcagacagcccggcggcagcggcaacccgatcacgatcgcgccctccgccccgggcggcagatcgttgccggaggcgtccaccacccgcacccgataccccggcatcggcagcgacggcgaccccggcctggtcggcaacgcctcgatcccgcgcgggctcgccgcgatcggccaacccgtctcggtctgccaccagttgtccaccaccgggaccccgagcaggtcaccggcccaccggtaggtctgcggatcgagccgctccccggccaggaacagcagtcgcagggcgcccaggtcgtacccggacaggtgtttgccgtccggatcctccttgcggatcgcgcgcaccgcggtcggcgcggtgaacaggcagaccacccggtgctcggcggccacccgccagaacgccccggcgtccggggtgccgaccggcttgccctcgtagagcaccgtcgccgcgccggccagcaacggcgcatagacgatgtacgagtggccgaccacccagcccacgtcggaggccgcccagaacacctcgcccggccgcacgtcgaagatgtgctccatcgaccagtgcagcgccaccgcgtgcccgccgttgtcccgcaccacacccttgggccggccggtggtgcccgaggtgtaaaggatgtagagcgggtcggtcgcccggaccgggacacactccgccggcaccgcgtcggcgaccgcctccgcccaggtcagatcccgctcctcgagcagcggggcgggctgctcgggccgctgcagccacacacagcggcccggttggtgggaggccgcgcgcagcgccgcgtcgagcatcggctgatacggcaccacccggccggcctcgatcccgcacgacgtcgcgacgatcaccttcggccgggcgtcgtcgatccgggcggccagctcacccgccccgaacccaccgaacaccaccgagtgcacggcgcccagccgggcacaggccagcatcgcgatcaccgtctccggaaccgtcgccatgtagatcaccacccggtcgccgcgctccacccccagccggcgcagcgccccggcgaacagggcgacctcggcacgcagcccggcatagctgtaggtgcggacggtgccggtgaccggactgtcgtagatcagcgcggtgcggtccccgtgaccggcctcgacgtgccgatccagggcgttgtggcaggtgttcagctcggcgtcgggaaaccagcggaagatcggcgcctcactgtcgtccaggatccgggtgggcgcgacggaccaggtgatgccggcggcggcggcgcgccagaacgcctcggggtcggtgatgctgcgctcgtacgtctgccggtagtcagccatgatctgacgctgctccgcatccggccgcattgtccaccccgcttcaccccatgggagttccggcacccgcgagtccgacgccaccgccgctatagcatcctaggaggctaggcgtgttcctgaccgatacagtcgccgcatggacggttaccaggccacgctgtcgccgcggtggcgccgagcgctgctcctggtcgccgccggcctgctcgcgcccgccctctggctgcccgcggccggtggcccggtcggccgggccaccgcgatcgcgctggccgccgcccagatcgtcgcgctgcgacggctggaccgcgcgccccgcctggccaccgccggcatcctggtcgccggcacggccctctcgttcgtcatccccggcctcgggccgggcctggccttcgtggtgctctccacctacgcctgggcccgaccggccccggagagcctgtgggcgctgaccgggacgatcgtcgcggtcggcaccccggccgccgcccagggccgctggccgctcgtcgccggctggatcggcgcctcgctgctggcctggagctggggtgcgctgggccgggcccggtccgcccggcacgaggccgaacgccgccgggccgtgctggaggaacgcggccgaatcgcccgggagctgcacgacgtgctgtcgcacacggtgtcggtgatggtggtgcaggccgcggccgccgacgacgtcttcgacctgaacccggcgcaggcccgggcggcgatccgccgcaccgaggcggccggccgggaggcgctcgccgagctgcgcaccttcctgcgcaccgtccgggacggcgacgccgagccgcacgacgccccgccccagccgtcgctggccggggtcgaacggctggtgtccacgatgggcaccggcgggctcacggtcgctctgcgtcgcgagggggacggggagccgccggcgggggtgcagctgtgcgcctaccggatcgtgcaggaggctctgaccaacacggtgcggcacgccggagcgacggaggccggcgtgctgatcaggatcggtccggccgaggtcgaggtggaggtgtccgacaacgggtccgctaccgggccggtcacggccggcaacggcatccgcgggatgcgggaacgcgccgtgctgaccggcggcaccctcaccgcggccccgcgccccggcggcggcttcctcgtcaccgcccgcctcccctggcaggccaccgcatgacagcccgcgcggaggtcgtgaagatcctcgtcgaaaaggccggaaccgccccgacaggcccccaccggaggccggccggccgccgcatgaagagcccggaacgggaggccgccggatgaccgtccgggtcctgatcgtcgacgaccaggcactggtccgcgtcggtttccgcatgatcatcgaagcccgcgacgaccttcaggtggtgggcgaggccggcgacggcgagcaggccctccgcctcgccgcccagacccgtccggacgtcgtgctgatggacgtccggatgcccggcatggacggcctggccgccaccgcccggctcaccgccctcccggacgccccgcgggtgatcatgctgaccacgtacgacctggacgagtccctctacgccgccctgcgcgccggggccagcggcttcctgctcaaggacgtccgcccgggcgatctggccgaggcgatccgggtggtcgcccgcggggaggcgctgctggcgcccaccgcgacccgccgcctgctggaccgtttcgtcgccgccgacatgacgccgcccggcgccgacgtccggctggaccggctcaccgcccgggaacgggaggtcctggagctgttgggccgcggcgcctcgaacgccgagatcgccacccggctgaccgtcacggaggccaccgtcaagacgcacgtctcggcggtgctgcgcaaactcgatgtccgcgaccgggttcaggcggtcgtcctggcctacgacctgggtgtggtgcgcccgcgctcatcctgaaggaggagaccggagacccgtctcgcgccggaggatcgacggcccggacattcctaccgtcggggcatgacgaagaagacggttgccgcgctgctcctgaccggcctcgcgatcagcctgctcggcgcggtgctgaccctgctgctgcacgccccgatcctcggctaccagcgcgcccaccagccgcacgccgatccggctgccctgtcccgcacgttgtggacccggccgctgaccgtgttcgtcgtcgcgatcctgtacgcccgcttcgtacgccaactgctccgtggcgatccgcgggccctgcgccgcgttcggatcgtctccgccgccggcctggcgggtgtctgctggctgctggtcagcgccgcgtatccggcctggctccgcgcgatccagatcggccagttggtggtgctcgccgccctcgtcatcacggtcaacctgcggaccgtccggtccgccttcgacgccccggtcccgcccgacccgcgcccccgcaacggtcgcgccgcctggaccctgatcctgctcaccccggtcgtcgccgagctgaccatgggcaatgtggcgctgcgtgacctgatctactttccgatcttcatcccgatctacggcgccggggcgctgctcatccgcgagaccacccggcgtctcggcggcggaacggccggcctgctgctgctcggcctggcctacggcatcctcgaggagggtctcgccctgcagggcctgaccagcccgcacctgtatcacgcggcggactgggcgcctcgcctcctgggactgaacacggcgtacgcagaattgaacctgatctatcatccggtgttcagcgtgctgatcccgatcaccctgaccgagcatctcttccgcactcacggtgaccggccctatctgcgacggggcgggttgatcagcaccgcggtcgtcgcggcgctcggcgccggcctgctccggatcgcggtgccgcccaccatggatcccggctaccaggtgccactgctcccggcggtcctttttctcacggtcgcggcgttgctcgccgccgccgcctatggtgtacgccgtaagcccgcccgccgcggccccgcccccgccgcggccgccgcaccggcccccgtccccgccgcggcctagctagctagcggcccccgccgtgatcgccgggtggaccggtgccgccgccctcggcttcctggccctgatcttcccgttcgccggcgcccgccagccgttcttcacccacggcacctgggtgctgctcccgatggccggcgccgcggtcatcgtgctcctgatcgcccgcgccctgcgccggtggcgtgccgcaccgacctggaccgccgcccaccggctcgccgcctgcttcggcgcgctcaccgggcacaccgtgttcggcctgatcgccaacgccgacacgctccaggaccggctgttcctcggcgcgctggccgcgctcaccgtcaccctcggcgcccgggcgatccgccccgcacccggcatcccggcgggtgccgccgggtgatccgccacctccggcgtccgctgatccgccccgcacccggcatcccgccggccgccacccggtgatccgccacctccggcgtccactgatccgccccgcacccggcggcccccacccggtgatccgccacctccgacgtccactgatccgccccgcacccggcatcccggcggccgccgcccagtgattcgtcaccatcaagccgatccggggcggtatcggcacgtaacctgcttcctatgatcgacaggccggtccgcatcggacttcgactgcagcgccagcgaccgcactcccccgcatcgaatcccgctgggagaagttgaacccgaagccgacccgcgacatccccgtcctgatcggcagggaggcgagaagaagacgctccgcctcacggccaagcacgcgaacatctggcacagcttctccgactcggaaaccctggaacgcaaactcggcgtcctcgggcagcactgcgccgacatcagccgcgacccctccgagatcgagatctccgtgatgggcaagaccgaagaccgcgacaagatgtacgagctgggcgcccgcctgttcaccatccacaccggcggccccacccccgacctcaccgaactccgtgagtttctcacctggcgcgaccagcgcaacgcataggtgctgcggcggggacgtcaccgaatagtgtgctgaaacccagtcgaggtctcagtcgtacccgcaaacgcaagaacattcactggatccgatggaattctgggtcggagattcggaccaacgatccgatcaccggcgggcctgcgggggcgcagcaagctgcagcatcctttctgcggctgcaagcagctcgggataggtgaccactttgacccggctcagatgggagttgtaggtgcggattgcctcggcgatctcctgccgggtgaactgctcgcgaacgaacgcaggggcgccgatgacgacagtcatcgacgctcggcgggcgtcgacaccgtactcgttgagaacggtgtggcgctgctcgtccaagccacgaaggtagttcatggcttggacgacagcctcgtggactggttcaccgacgacggctcggccccgatgagcaacgacaagtttcgcgatgcacgcgcgtttgatctcgacaccatgaagggtgccgtcgccgcggataagtgggatgtcgagctgatcgctcaacgacagcgctcgccgagcggcgacacccatgaattcgcctccgaacacccaggagtgctgctcaaggatgcgctgaatggctggctctcgggtgccgggatcgaggacaagacgtcgtagctcggccagcccggcggcccgaccccgccggatcaccagttcagcgaactcggcgacgtccgccagttctggtgctgccccggctggcgcttcccgtaaccgatcggcggcctgccggtaaagctcggagtctgacaccgaccgcgttgcgggacccgataccggctcgctggccgaccgaatcaccctcagccgtagtctctgacgttgactccgcggttgctgctccgctgacacgaacggggtgagcgaggtaaccgggtgtacgcgcagcaacggcgctctgaactgccgagccgtgggcggattacccgggtccgtatagggcggcggcaacgagggcggctgaggcggggctgccgcctcgatccagccttcgaccgggtgctcctgatcaatgatcacctcaccgaggtaggtgaccgatttcctgccgttgctttgaaagactcgcagaggaagccccgagcgcaggtgccgcagaacgagccggttttcgaaacccgcaggagttgcgggcggctcgccgcgaccaatatcttccggcttgccgacaagcaccagcgcaccgtcgtcggcccaacggtgggtaaacggcacgccgtggcttccggccccaaggaacagaaatgtgttgggggtggtgccgctgcgcccgatgctcccctgccgttgaccgccataaacgtcgtgcacatctccgcgcccgacgatggtgccggcgtcgagatcccagcccatcggccattcatacgggcccggagcctgcgttccccgcagcaatgactcccacgtctcaacagtgatctcaagcggtgccgccggcatgtagcgagcagcccgaacgtaccgggcttttgtcagcccgccgatgtccgacagcaggcgcatcggcaccggtgcgctgaggtaggtcttgtcgaaccggaccgtgatctcgcgcggttggcatcccagccgctttcctccatcgcggtgatgctctgcgatcaccgaggtagcacggccgtgcgcaacaacacctccataacggcctacccggatcaatgcgatcccgtcgccttccgcgacctccgccacgtcgtgttcgtcgcggctacggcagtaggacgtctcccatccacgggtgactcgatggtgtggactttcgtaggcagccgggccaccttcggccaccatcaaccactgtttcacaagacctccacaccataccgaagccatctgagaacgctcactgactatggctgggcaccaaccagcggcgaggccgccacgatatcgacagggtctgacacgttgagccaacgagacccaacagccctcatccgccgtcgaacgaaacgccacgcttgagtgttgtgcttagactcgcccagggcgggtcagtggaggtggtgtggagtgcgggacgcgctgatcgctgatctcgtgacccgggtccgtcactttcatacaaccggctccccggagccgcttctctccgacggcggtctggatgctgcagctgagcttctccggctggcgacccacgagataaccggccgcgaggacgtcgacgctgatgccctgcatgctgtcgcggcataccaatggacgcgtggtctggtctggcagtccacaaccgctacgcacgatcgtccgggcgaggacccggagggtcgggcggaggttgagttcgctggtgctctcgccacctacgaactgctgttcatggtcgatcaccgccgggtgccacgtgatctgtggccgtacctcatccgcgagaccggccacgatccctggcaagacccactggaccgcgccaaggatctgctcgttgatgcgaaagaggccagcgatccggctgctgtcgcgacggtcatcgagcagttgcagaacctcgacgagcccagcgacgccggcttccgtgacagccttctcggcgacgcccatctggtccggttcgacattgtccgggattccatcgatctcacgaacgccgtctcggcctaccgtgccgccctcgatcggttcgacgccggttcggcttcgtacacccacgcctgccagggactcggggcggcactcgggaggcagggccagctcgccctacacttcggagagcaggcgtcggtgctgttgacggaagccgtcggctggctgcgccgagccgccgacggcgacacgtcggttctgccgtatctgcagcgagtcatggctctgcgaatcgaggagaaggtccgcgccggatctgttcccgttgaggagcacccgctcgcagcggatggcgaggagcgtcggcaggctgtcgcgttgctgcagctcgccgatcacgtccggacccgagtgttgtcacaccaggaggcgacccggcacgccgccgatccgtcgttcccgctatccgccacggcgattgacctagccgtccacacatccgtggcgaacgtggaggtggcacggctcgccatggacgcggcggaacatcgttggggagccacccgcgacagcccgtggtggacggccgccgacgcctacgtcgaagcggtgagacacagcttgctcgacgacccggacgccgatcgtctcgccgccgcgcacgccgtggcgaccaggcagctcacgatgctcgtcgacgagcccgccgagcgcgccggcaccctgttcgccgcgggcctgctctacctgaccccgtatctaggaacaatgtccgggctgacgttcgatggcgcccaccaattgtggctggctcggcatcagcgccggctgaccgcccaccccgagggtgacccgacacccttgccacctcctgacgtcgccgccgaccgcgccgtcgaatatctgcggcaggcagccgacctggccgtcggccatgaccgcggccggattctcaaggcgctcgtcgaggcgtattcgtttcgagccgggatgcgccaggagtccgccgacgatgaggcactggcggggtgccggacggcgttcgacctgctggacccaacccgtgaccagctcagtttcctttacgtacttcgcgtgctgtatcgattcggcgagatcgccctgccccccgacctgaactcgctgttggcgatgcccctggccacggtgcgggaccggtacggcataccagaggcgtcgtcggtctttgccgaggcgctcacgctcgccggtgaggcgatgcgccccgatttggaggccgagctactcgccgctgccgacgaccacctgcccgtactggcgagtgacgcgcagcgacgggtccggtggcgcagcgaggtgcacctgctcgcggacggcgtcctgccctgctcgccggacctacgagtcgacgccgacttggtcgaccaggtgcgggcggtggcagctgggcctgagctggccgctacgtttattcacctcgccgcgcacaccgccttcggcgcaacaccggaactcatcgccaacgctctcgatctgctgtccgaggcacaccaggaagcgcctgagctgtggcgatggcacggcgacgccatcgactacctcgaagccggactcacctacgatctggccacccgctccgccgacgacggcacgcacccggagtcggcccgccgattcggtgccgccgcgttgcggtacgcgctctgccgccagcacgacctggcgctcgcgagcctcgacgccgggcggcttcagatgaccctttgcgacaacgatcagaccagctcggccgcaatcgtgctgctgtgggcagccgcgggcctcagcggtaccccaggtgagcctgtggcctgggcactgttcgagttctaccagcggatcttgtttcatctcgccgaccgtcaggtcgacgtcaacgccgtgatcatgctgcaccaggccgccaaaggccgctggctggcctcggcactgcattcccccgggccgttcactgccagcccacgtctgctgcgggaacttcgggaaatgccagtcgagcaaagcctgcccgacatcgacctgccaggcggagcagaaacggtcatgaccttgtacgccggatccggtgaagccgagaccgagaccggccctgacgcggtggcccgcaaccggcaacgtgcggccgaccgccggatcagcgcagaactctcctccgcccgcagttcatggcaaccaccaccgatccccctcgacgagctgcagtcgatgctgccaccggagacggtgttcgtgtcactgatgctcggtgaagcccgcaaaccgtctggcgatccatccggcgcgctgcacgccatggcggtcacccgcgatgccgtcgaataccgcacgttgctgatcccggacgctggtggcagcctgatccggctctaccgcggcagccaccacctggccctgtcccccttcggcatccgagtggcgcaactacgcaacagtgtcaccgccgacccgctgcaccgggccgtcagccgcgacgcccagcagcacctgtccgaacgacccgactcctatctcgccggtttcgccgaccgcatgccccagtggcacgccgaaggccgccgtcacctgtgtgtctgggccgacggaccgctgcactacgtccccttccacctgctcaccagcggaacaggaccggccgccgacgactggaccgtcacgcagatcgccagtcccgaaatgctccgcgaacagccaccgtcagttcggcgcggcttcgtcgcgttcgcttcaggtagcggcggcaccgctcacggcctacctgtcgaggacgccctggagagccacgccgcccaggtcgccacagcgatgggcggtgaggccgtactcggctccacggctacacccgaacgcttcctctccggcctgacccaggcacggtacgtccacgtcgccgcgcacggcagccacaacgaatgggcgccctggttccagtgcctgtacctctcgggcggccgggtcttcgcccacgacatcctgcgcaccgatctgcgcggcgtggaactggtcaccctgagcgcctgcgaatccgcgctcggccgcttcgacctcaacgacaatctgcgcgggctgcccgccgccctactttctgcaggcgccaccgccgtcatcggctgcctctggcccgtccacccgaccgtggccactgaattcttccaccacctctacgaacggctggccgtcgaccccgaccggcgttcggcgttccgggccgcccaacagcgcacccgcgacaggcatcccgcctaccgcgactggggcaccttcacgttcgtcggcaactggcgtaccactatccccgaggagccgcccaatgactgatctcgacacctcgatccacgaggtcgacctcctgctggaaccccgcctgcagtcaccgggagcagcaccccgaattagcggccgagtcacgctcggcacaccggtggtacgcccgctcgaagccggcaccatctccgccgacccgggctggcgcgaattccttgaggcccaggccgccgacaacgactacctcatgctgagcgtgttctgctcgttccgggccgtccccaacggcgacccgatcgttgacgcagccgtcggcgtcaacctgcaggctcccggcgaacccgccgaccgtcagccgatcgcctggtcgatcagccccaaacaccgcgtacgtacggtgccccgtaccgggcggatcgcgctcaccgccaacctcacagtcgccgaagccgccattgagtacgcgccacaaggcaaccgcgaggacctgttcctcgtcggcatgggcgaacgcgacagcgaccccgaatggaggttccgcgccgtcagcggccagccactgatcggcgacgaggaactgacgatcgtcgtcaagaagccggctggtgtcccggcccacgccgacatctccctcgccgccaccatccgccaccggcgcctcggcctgatcccttaccgcgccgacctgccctcggtcctccgctccgtcaagctcggcagcttggatggttaatcctcagctgcgaagccgagcaatgtctgatgggatgagcgccgctcatcccatcgtctcgtggcggcgctcggccggccgcggtgctcgacgtgagtcaggacgaggtgcagtttcgcgcgggagatcgcgacgaagaactccgacatgatcgtcgtcaaatctttactccagaagagctgagtctccacgccgagcactacgactttctcgaattctaagcccttgcacttgtggatagttaggactctcacggcgtcggcttcagaaagccgccgcagggctagtacggcgttgccgtctacggcgagttcccgttcgaaagcagccatcgtctgcacgataaggtcgtcaaggcggttgccctgctggtagctggccgacaatgcggtcaacaccggccgggacaccagacgcaggaatccaatgacgaggttccgccatcctgcggagtcgtcgggggtgaatgttgaagcccgtacggcgatccgagccgtggtgatgattcgtttgacctggctgtcgaagcgtgcgacctcgtcgtcggaggcgttcgtgcgggccacgatcctcatcaggtcggcgtaggcgtggggttgccgatcgtcagcgactactcgaaggaaattgagtacgagggccgcgatcggctctgcggtgagatcctgactctcctgctcgttgcggaaggcgatgccgcgtgcacgcagttcgtccccaagcaccgaagcgaccaggtgcggctggttgcgtacgagcacagcgatctcggccggaggcacgccttgaccgagccatccggaaagaagatcgccgactgttcgcgactcctggtactcgtcagagaagccgaggacgtcgatgacgccatcatcaccgaccagatcctccgcagggctgacggcactggggtccatctgggcgatcatccggttctgcatgcgccgcagtcgtggcgcggagcggaagttctgatacagcggcagacgcacggcggagaagtcgtcggcgaaggtctccagcactccgtcgagagcaccggcccaaagcatgatccgctgcttggtgtcgccgacagcggtcacgatggcggtcgacggcccgaagaccgctttgatcagctcgtactggtccgctgtgcagtcttggaactcgtcgagaaagacgtgactgtaggtctggtccaggccccgccgggcatagatgttggcctggacgatctccagcccaagcggaaccaagtcttcgaacgtgatctgtttgctggcaatccggtcctgccgatcgatgcggtaatccgaatcaagggcattggcaccggtcagcgttggccggaagttgtcaacgaggcgcttggcgaaggcgtggaaggtgaaactgtcgaaccggtccgcgagcgtcggcccgcagcggcggcggacccgttcggccagattacgagcggcatcgaccttgaacgagactgccagaatgcggcgcgggtacggacactgaccggtacgcagcaggaagtctgcgcgctgggcaagcaactccgtcttccctgcgccgggcccggcggcgaccaccgcgttgaggtcggccgctgtcgccgctttcagcgcattcggttccagcgtcaggccgtctgcgggccgccagtgctcggggcggatcattccggcaggccgcccaggaccgcgcgcacatgctcgaccatcctggtaagcaccatgggtgattctttgagcaagtgttggtcgtcgaggctagccagggcgctcagatgtgtcgcaggcttgctgccgaggtcaaacttccggtgatactcgtcgaagaggtcaaggacctcgctgcgaaggcggatctcgtttttgtggctctttccaagcacggccacgacggtctgcgggtccggttttgcgggagggtcgacggcataggcggtcggataggccgccagcatcatgaggtcaaggtcgactggctgggagaagaagacgccatgctgctccagcacatcgatcgggccgagcccaccgccgatgtcggggccgcatccgggctgcggaaaatcgcagtcgtcatcccacttcggcaactggtcgatctgggcttccgcgaacgtatcgggttggactgcattgagctgccgcatggcgttgcgtaccctgccccagccgccgtgataacggccgctgtccaggtcaagcagggtgacgtgcgggatgtggagttggttgagcagccgccagaagtggttgacgtgccgaccgcccagcggaaccaccgacacggaggcgtcgtcttcggcgatgccggctgcggcgaggactcggggcagtaccacttgctcactgtcgccttcgcccagcacgacaaggcgggaaaagtacagctccgggtacgcctggaccgcctcgcggacgtacttcgcggccaatacgtcgtccgccggaacaacgatgcgctcgacagtcgtccgccgggcggcgtcgagccgcaagaagcgaatcgtgtccgggtcaacccgtcttagcagagccggcgcgtgcgtggcgatcagcgcctggacgtcgccggccgagcatgcgccgcgcacctgacggatgatacggccaagatactgcggtgcgaggctgttctccggctcctcgatctcgatcacgacgtgcacaggagggcgcagccgatctggatccagggaagtttcctcaccgcgcagaacccgccggaccaacgattgccaggagaggacgagcgagatgtagagcaacgacttctgtccgtcactgagccggtcgaatggcagggatgccccgccgtgcgatggggaaaacgtcaccgtaagttgacgcaacaccccctcaagatcgccacgcccgaaggcaatcgagggatctcggaagtagccgccgctgtgcaggttctgccactgcttggtcaggtgcacgccgatacctgccaccgcggcgttggcgaccagtgtgtcggtgatctgtgcagatagatcgccaagcacctcccgctcgctcgtccagtccgctgctcgcaggctacgtccaatcagcgaggccgctgtataggcgatgtgatctaccgggtcacggcgggctggaaggtagtacacctcgatctgcgcgcggtcgaaacggctcatctgggtgcagctggtcggcacccctgccgcgtcagcctgcaggacgtactcgatcttctcgtcgatgactccgtctgcggccagttgtgccgtcagccgaactcgaatctgcgggatcccgtccgccgtatcgatcctcatgtgcgcgaagaacggcggtaccgacgcgtgtgtcccgccggcccccgcttcagggcacaacacatcgacctctagccagagggtcggttgggcatcctgcacctcactggcggaccgatcgaccggcacgtgaaagtcctccggctgaatttgacgctgcgcggccagtggactgaacaaccgggaaagcgcctccaaagcggcagtcttgccggagccattcgggccgagaatgtaggtcaagtcatcaagatcgatcgttgtcggctcggggccgaacgactgaaaattgctcagcctcaacgcaacgatcttcatcgacagtctcccgttcctcacaggctgtgtgccatcaggccatccggcggcgaagcctagacgcctgtgaatcggaagccgtcccccaaaaggtcgaattcacctcatcgggtgggggccacacgttctcgtcgcgcagtcaccggctgcctaccagggccggggccaaccggccccggcgctcacccgtcgcccctcccgccagcgcatccgcagcaggcgccacccggcatcccggcggccgccgcccagtgattcgtcaccatcaagccgatccggggcggtatcggcacgtaacctgcttcctatgatcgacaggccggtccgcatcggacttcagctgcagccccagcacatggattacgccaccatccgccgcaccgccgccgaggccgaggacctcggcgtcgacgtgctgttcaactgggaccatttctatccgctgtacggcgagccggacggtctgcacttcgagtgctggaccatgctcgccgcctgggccgagtccacctcccgggtcgagatcggcgccctggtctcgtgcaacagctaccgcaatccggaactgctcgccgacatggcccgcaccgtcgaccacatctccgccggccggctgatcctcggcatcggctccgggtggttcgaacgcgactacaccgagtacggctacgagttcggcaccgccggcggccgcctcgacgacctggcgggcgcgctgccgcggatcgagtcgcgctggggcaagctgaacccgccgccgacccgcaagatcccggtgctgatcggtggcggcggcgagaagaagacgctgcgcctggtcgccaagcacgccgacatctggcactcgttcgccgacgcggaaaccctggagcacaagctgggcgtgctccgcgggcactgctccgacgtgggccgcgacccgtcggagatcgaggtatcggtggcgagcaagccggacagccgcgaccggatgcacgaactcggcgcccggctgttcaccgtcggcgtcggcggcccgaagcccgacctgagcgagctgcgcgaagccctcgcctggcgcgacaagatcaacggataacgccggcagcccggggtcgctctcctctgggatcgtccccgggcctccgtccgcatcaagcgcctccacccccggtcacccaccggcccaggtcgcccaccgccccccgagcacccaccggtcccgaagcccagcccatggaattctccgggcggacggtgctgactcgaccgccatgcggggtggagtcgcttgaccccgatacggcgggatgctcggaccgcttcggcgtgatcggcgaaccggaccgccgatccggaccgccgcgtccgcgaggacggaccgcgcggtccgcgtcggctgcggcgcgcagtgtcaggtcgcccgggggaagaccttctcgaccatggtcagcagcgtggtggtgagcaacgtgtgcacctggtcgcgggtcagggcatcgcgctggagccactcgcgggcggtgtaggtggccaggccgacgtaggcgcgggccatgccgcgcaacgcctctcccggctcagcggccggtggggagccggacgccgaggcagccggcggggcaccggccgtgatgccggatgacgggccggcaggacctgcggccgggaccgccggagggacaacgacggttgacgggccggccggcccggtggccgcagcggtggcgctggacgcggtcggggccgggccgacggcggacaggatgctgtcggcggcgatgtcgacggcttcggcgatgacctcgtcgacgtcggggtcgccggccatcccgccggcggtgatggcggccagccaggacgtgctgtgccgggagaccacgtcgaggaaccaggtgacgatggcgtcggcgcgttcggcggggccgccgtccgggaggcgggagagggcgacctcggggacggtcagcatcacccggatgacctccaggtagagctccttcttcgtcccgaagtagtggttcaccaggccgcgggctacaccggcgccgcgggcgacgtcggtggtggagacgtcggcgtaggggcggtcgccgaagaggcggatcgccacggacaggatctgttcgcgccgggcgtcgggttcgagacgccggcggcggatgatcggcgggcgcgccggcccggcttcactcacagccatgatccggctatcctcccccatcacggaaacccctgccgacacaccggaaacgatcaccccggaaacccgatcggcatcgcccggccacggcggtcacatgagaaacaatcaccccggcaaccccggtgcgcatcgcggggccggtaggtgcacagcggaaacgaggacccccgcgacaccgcagaccccgggcgccattcccgccgctgccgccccgcccggaaccggaccgtacgtcgcgcacccctccatctcgctccgagatcgggtgcgcgtcgatgcggtcagcgggtttcccgatggataaagccaattcatcacacccttgttgacacagcgccaatagtgatcgagggtgtatcgatgccgacgcctggactggacggctacgccgagccgtggcgcatgccggaacacgacgacctggccgagatggcccgcaccttctttctcaaggaggtggtgccgcacgcggcccgcctcgaacagcagggccatcccgaccgggagcactaccgccgggccggcgagctcggcctgctcgggctttcggtcccgcaggagtacggcggcgggggcggcgacttcacccacgaggccgtcgtgctgcacgagcagcagctgaccggcgagggcagcctcggcctggccgtgcactgcgggatcgtgaccgggtatctcgccgcctacggcaccgaggaacagaagcgccgctggctgccgggcctgtgcagcggcgagttgatcggcgcgatcgcgatgaccgagccggacggcggttccgacgtgcaggcgatacggacccgtgcggtccggaccggcgaggacctcctggtgtccggttcgaaaaccttcatcaccaacgggtatctggcggacttattggtcctggcggtgaagaccgatcagtccgccaaggcgcacggcatctccctgctggtctgcgagctggacgacgacgcccccggcttccggcggggccgcaacctggagaagatcgggttgcacgcgaacgacaccgcggagctgttcttcgacgagttccgggtgccggccgccgacatcctgggcgggccggacgccgagaacaccggcttctaccagctgatgcagcagctgccccaggagcggctggtgatcggggtcggtgcggtcgcggcgatgcagcgggcggtggagctggccaccgcgtacgcgaaggagcggaccgcgttcggcaaaccgctggtcggtcaccagaacacccggatggttctcgccgaatgcgcgacccggacccgggtgtcccgagttttcctggacgactgcatcgcccggcacacccggggtgaactggatgtggcgtccgcggcgatggccaaactgttcctcaccgagggacagtgcgaggtggtcgaccgctgcctgcagatcttcggcgggtacggctacaccaccgagtacccgatcgcccggatgtacgccgacgcccgggtgcagaagatctacggcggcaccaacgagatcatgaaggagctgatcgcccgtgtcctctgagcaggcctacctgtacgacgcggtccggaccccgcgcggacgaggcaaggacaacggcgccctgcacgggacgaagccgatcaccctggtgaccgggctaatcgacgcggtacgcgagcgcagtcccggcctggacccgcgacggatcgacgacgtggtgctggggatcgtcacgccgatcggcgagcagggcggcgacctggcccgctcggcggcgctcgtcgcggggctgccggacacggtcggcggcgtacaactcaatcgtttctgtgcttccggtctcgaggcggtgaatcaggcggcgtcgcggatccggtccgggtgggagcacctgatcctggccggcggggtcgagtcgatgtcgcgcaacccgatggggtcggacgggggcgcctggttcctcgacccggagacggcgctggccaccagtttcgtgccgcaggggatcagcgccgacctgatcgcgaccctggaagggttcacccgcgacgacgtcgacgcctatgcgatccagtcgcaggagcgggccgcgaaggcgatcgccgggggcgcgttccagcggtcgatcgtcgcggtgcgcgatccgagcgggctggagatcctggcggtcgacgagcatccgcggccggacaccacccgggccgggctggggaagttgcggccgtccttcgccgggatcggtgagcaggccgggttcgacgcggtggcgctgcagaagtaccactggctggagtcgatcgagcatgtgcaccacgccggcaactcgtccgggatcgtggacggcgcgtcgctggtcgtggtcggctccgagcgggccggccgggagctggggctgacgccgcgcgccaggatcgtcggggcggcggtgagcggcgccgaccccaccctgatgctgaccggcccgacgcccgccacgatcaaggccctgaaagcagcggatctcgaaatctcggatatcgacctcttcgagatcaacgaggctttcgccgcggtcgtcctcaagtacatccgcgatctgcaactggacccggacaaggtcaacgtcaacggcggagcgatcgctctcggacaccccctgggcgccaccggcgcgatgctggtcggcacggtggtcgacgagctggagcgccgcgatctgaaacgggccgtcgtcaccctctgcatcggcggcggcatgggcgtcgcgaccgtcatcgagcgcgttacggagttcgacaagtgatctcttacgacaaggacgaggccggcatcgtcacgctgacgatgaatgacccggaccaatcggcgaacacgatgaatgccacctacgtcgccgccatgagcgccgccctcgaccgcctggaggcggagcgggaccaggtcaccggcgtgatcgtgagcagcgcgaagagcaccttcttcgccggcggcgacctgcccacgatgagcagggcccgcccggaggacgccggcgccctgttcgacctgctgggcacgatcaagaaggacctccggagattggagacgtacggtcgtccggtcgtcgccgcgatcaacggcgccgccctgggcggcggtttcgagatcgccctcgcctgccaccaccggatcgccctggacgcccccggcacccgggtcggcttccccgaggtgacgctgggcctgctcccgggcgccggcggcgtgacccgcaccgtccggatgctcggcctggctcccgccctgaccgtctggctgctcaccggcaaacgcgtgaagccggccgcggcccgggaagccggaatgatcgatgaggtcgtctcatcgcaggacgagatgatggcccgggccagggagtggatcgccgccaacccggacgccgcccagccgtgggacaggccgggctaccggatgcccggcggcaccccggccaccccgaagctcgcggtccagctgccggccttcccggccaccctgcgcaagcagctcaagggcaaccggatgccggccccggaggcgatcctggccaccgcggtggagggcgcccaggtcgacatcgagaccgccttcaccatcgagacccgacggctgatcacgctgctcaccggccggatcgcgaagaacatgatcggcgcgttcttcttcgacatgcgcgcggtcaacggcggcgccgcccggccgcgggtcgacgtcgccccggccaccagaatcgccgtgctgggtgccgggatgatgggcgccggcatcgcctatgcgtgtgcgcaagccggcctggaggtcgtggtcaaggacgtgtcgcgggaggcggcggcccgcgcggtggccgagggtgacccggccgtgctggcccggatcacgccgaccgccgacgtcgaggacctgcgcggctgcgacgtggtgatcgaggcggtgttcgaggacccgaagctcaagcaccaggtgttcgccgaggtcgagccggtcctcgccgcgggcgccctgctcgcctcgaacacctccaccctgccgatcaccggtctggccgagggggtgacccggcccggcgacttcatcggcatgcacttcttctcgccggtcggcaagatgccgctgctggagatcatggtcggcgagcagacctcggacgccgcgatcgcccgcgccttcgacctgggccgccggatcggcaagacgccgatcgtggtgaacgacggccgcggcttcttcaccagccgggtgatcggccagttcatgaacgaggcggtcgcgatgctggccgagggggtgccggccgcgtcgatcgagcaggcggcgctgcaggccggctacccgaccgggccgctcgcgctggccgacgaggtgacgctgacgctgatgcacaaaatccacaaggcgtacgcggcggccgggaccaccgccggtccggcgaaggcgcacgcgctgatccaggagatgctggagcggcacgaccgacccggacgatcctccggcaggggcttctacacctacgagaacggccggcgcggcagactgtgggacggcctggccgggctcgccaccgacgagggccgcgccatccccttcgccgacgtgcaggaacgcctgctgttcagcgaggcgctggacgcgttgcgctgccgggccgagggcgtgctgcggaccgatgccgacggcaacatcggttcgatcctcggcatcggcttcccggcctggaccggcggcgtgctgcgctacgtcgagcagcaccccgacttcaagggccgggccgccgagctggccgcccggtacggcgaccggttcgccccggcatgaccgcgctgcgcggggtgcgggtggtcgagctggccgggctcgcgcccggcccgttcggctgcatggtgctggccgacctgggcgccgacgtggtgctggtcgaccggcccggcggcaccggactggacggtccgctgcagcgcaaccggcgcacgctcaccctcgacctcaagtcgccggacggactggccggtctgctcgacctggtcgcgaaggccgacgtgctggtcgagggctaccgcccgggggtggccgaacgcctcggtttcggcccggaccgctgcgccgggctgaacccgcggctggtctacgcccggatgaccgggtggggacaggacggtccgctggccgcagcggccgggcacgacatcgactacctggcgatcgccggtgccctggagccgctcggccggtccgggcagccgccgcacgccccggtcaacctgctcgccgacttcgccgggggcggcatgctgctcgccgtcggggtgctcgccgcactgctggagcgcgagcggtccgggcgcgggcaggtggtcgacgccgcgatggtcgacggctcggcgctgctcaccacgttcctgcgcggtttgatcgacgccgggcagtggccgggcgggcggggggagaacctgctcgacggcggggcgccgttctacgacacgtaccggaccgcggacggcggctacctggcggtcggcgcgatcgaaccgcagttctacggcgcgctgctgggcgggctcgggctggacgacgcggaactgcccgggcagttcgaccgggacggctggccggagttgcgccggatcctcgccgaccggatcggctcgcgcacccgcgacgaatgggccgcggtcttcgcccggctcgatgcctgcgtgagcccggtgctgacgccggccgaggcccccgatcacccgcacaaccgggccaggtccgctttcgtcgaggtgggcggtcaggttcagccttccccggctccgcgattcgggcgtacgcccaatcaggcaccgcgaccaccggccaccgcgaccgtcggggaggttctggcgggctggcggtgaggggccgcccagccggaccgtttgccggaccggcccggctggacggcgtctgccgcggcacacccgcgtgagggatcaacgcgtccgggcgggaaacggcacgccccggacacggaacgtcagatggtgcatcacgccgcgcgtccggcgtgcttctcccggtacatcgcggcgtccgcatcggcgatcagcgcgtccaacccggcgccatccccggccgggcggatcgccacgccgacgctgaccccgacccgcaccgcccggtccggaccgatcccgaccggctgcgcgatcaccgaccggatccgctgggcggtgcgcccggccgtggccgcgtcggcgtcgcgcagcagcaccacgaactcgtcgccgcccagccgcgcggccagatcgccgggaccgaggaccgtgccgagccggttgcccacctcgtgcagcagcacgtcaccggcggcgtgcccgtgcgtgtcgttgatctgtttgaagccgttcaggtcgagcagcagcaccgcgaggggccggcccgggtcgtgctcggcggaggcggccaggtgcgcccggttcggcagcccggtcagcgcgtcgtgggtggcctggtgctgcagttcccgccggacctcctgcagggtgctgagctggcgctggaacgcgctcgcctgggatccgctgatgccggcgatcatcaggttcagcgagacgccgagcgcggcggcgcccgggtcgagcggcatcagcagcagcgaggccgaggtcaccgcccagaccgcgagggcgccgggcagctggtgccggatcgcggcgatggcgatcggcaggctcagcaccggccaggtgttcgccccggtgtgccgctcggtgaacaccacgcagccgatggtgaccgcggtgtccagagcgatctgcagggcgctgagcatcgcataccgcggcgaggcagggtgccgtgccgaaaaaccggacatcacagaggacaacgccataagagcagcgcacagatagagcaccggacccggcaccgattcggcggcgaacccccggacgccgagcgcggtgcacagcacgacagcgatgccgatgcagcggcagaccagcgcggcgatctccaccatccggcgccgggcgatcagtgagtcgtccagccggtcggttccgatgcgcatacgcccccgatcggcagccgtgccgcggacatgagaaagagggccggccaccacggtgaccggccctcgttgtacccgggaaatcagaacttgaaggcaccgaccagggcgcgcagctcctcggcggtccgggagacctcctcgctcgcctcccgggtctggttgacgccgctgaccgtcgcctggctggccgacgacacgtcgttgatgttcgcggcgatccggctggagccggccgccacctcaccgatgctgcggctcatctcgccggtggtggcggtctgctcctcgaccgccgaggcgatcgtcgtctggaagtcgttgatctgcgcgatcacctcggagatccggttgatcacctcgaccgcgccggtggtgtcgttctggatcgcggtgacccgggcgccgatgtcctcggtcgcgcgggcagtctcctgggccaggtccttgacctcgctggccaccacggcgaagcccttgccggcgtcgccggcccgggccgcctcgatggtggcgttcagggcgagcaggttggtctgctcggcgatgctggtgatcagcttgatcacgttgccgatctcggcggacgactcgccgagccggcggatgctctcggtggcgcgggcggcctcggccaccgcgaccgaggcgacctgggcggcgtcggccgcgttgcgggagatctcccggatcgacaggcccatctcctcggagccggccgcgacgctctgcacgttgcgggagatctcgtccgcctcggtggcggccgagctgctctgccggtcggtgttgtcgaccgcggaggcgatctcgccggagaccgcggagagctgggtggccgcggtggccagcgagtccgagtccttggcgatggtgatcatcgactcacgcagcttgtcgagcgtgtggtccaggctctgcgccatggtgccgagctcgtcgcgggtggtgatcccgctgcgcacggtcaggtcgcccttgtccagcccgtcgatcaccgcgccgattctgcggatcgggccgaggatcgaacggaccagcgggagcgccatgccgatcagcagggcgagagcgatcagcgccacgatgatcacggtccaccgggtccgcttgatcgccgacccggtcttctggtggccgtcgtcgacctgcttggtgacggcatcggtgagggtgtccagctcgccgtcggtcttgtcgttcttgtcgccgatctcgccgatccgggcgcgcaccgacctggggtcggccacaccggccgtgacgaagtccgagatgaacgtgttgaagtcgtcgaagtcgccgcggtagccgttcacctggccggcgatcgagctgggcaggtcgcagccggagaccgcgtcgagcgcctcggacgacgactgcacgtcatccttgacgtcctggctgacgtcggcgccacccgccgcccggtacgcgtcgaccttcagctcactctgccggttgttcaggtggttcagcgcggcgaggccgcactgcagccggctgacctcgttcgccttgctggccacgctttcctggccgatcagggcgatcgtgccgatgccgccgagggcgaccgcacccgtggcgacgatgatgcccagccgtttggccagaccgatgttttccaggccgagcatcttccctccacggttggctgactgaccaccatttcgaccgtgatgtggatcgcctgagggagctttggcgggtttgcgccgtttgctcggtatccttctggttgccgctagtggatcttggatctccagtcggccgggaccgcgccggccggacccgggaccggctggtccaccggccggctggtcgggggcgccagctccggcccactgccggcctgctcggccgcgaagtcccagaaccagtcctcacccggctcgaacgactggatcaccgcatgcccggtcgcccggaagtgggcggtggcatgctgcgcgggagaggtgtcgcagcagcccacgtgcccgcaggcggcacagcggcgcaggtgcacccaccagccgccggcctcgaggcactccacgcaaccggtgccggacggcgggacatcggactgaatcgacgcgctcacgacaggaacctatcgcacccggtcgtactcctcctgggccacccgcacccgcggcatctcgccctcgacgaggtcgatcagctccttgaacttggcggcgacccgctcgccgaacggggtcaggctgtattccacccgcggcgggatggtggcctgcacctcgcggcggaccaggccgtcgcgctccagcgcctgcagcgtctgagccagcatcttctcgctgaccccgtcgacccggcggcgcagggcattgaaacggtaggtgccgtcgtgcaacgcggccagcgcgagcccgccccatttgccggtgatgtcggcgagcacgaaccgggacgtgcagtcccgggcgaagacgctggggatcaggtcgtcggcgggatcggtcatgacactcaccatactcccccagggttggcactttcgaaaagttagtgcattctcaaatgcagcacttcacttcccacacctgatgaggggtacgccatgaccatcgccgttgccggagccaccggacacctcggccgcctcgtcgtcgaggccctgatcggccgcggggtcgagccgtcctcgatcgtcgccgcggtgcgcagcccggagaaggcggccggcctgctcacccgcggggtccaggtgcgcgaggccgacttcgaccggccggagaccctgcccgtcgcgttcgccggcgtcgaccggctgctgctgatctccagcaacgcggtcggcaaccgggtcggccagcacgtcgccgcgatcgaggccgccaaggccgccggggtgcagctcatcgcgtacaccagcgtgctgcgcgccgacaccacgccgatcctgctcgccgccgagcacaaggccaccgaggaggcgctcgccgcgtcgggcgtggcatacacgttcctgcgcaacggctggtacatcgagaactacaccgcccagctgcccaccgtccggaccaccggggcgttcctgggcagcgccggcgagggccggatcgccggtgccacccggctcgactacgccgaggcggccgccgcggtgctcaccgccgacgacgtgcgcccggtctacgagctcggcggcgaccagccgttcaccctggccgagctggccgccgaggtgagccggcagtccggcgagacgatcggctaccacgacgtgccggccgacgagctggtcaccatcctgaccggggccggcgtgccggagggcttcgcccggatcctcgccgacaccgacgtgcacatccgggagaacggcgtgctcgacaacccgggcagcgacctgcgtgacctgatcggccgaccgaccaccccgctggccgacgcggtcgccgacgcgctgaaggcctgagccgtcaggccgggtcggtgacgtccgcgtactcgccgcccagcgcggcgaccgcggcgtcggcgccgacccgcagggccaccccgcgctcgcccgcgcccaggccgacggtccgcccacgggtccgctcgtcggcgatcaccgaccaggccgtggcggcgccgaacggcgtgatggtgccgcgttcgtacccggtcgccgccttcgccgtcgcggcgtccggcatcgacagccggttcacgcccagcacggcgcgcagtttcggccaggagatcgagcggtcgccggggaccaggacgaacaggaagtcgtccgggccccggcggaccaccagcgtcttcaccagatcgcgcagttccacaccctgggtggcggcggcctcggcgacactgctcaccggcccgtgccggaccacctcgtgggcgatcccggcggcggtcacggcggcgatggcggcgttcggcacccgatcaccgtagtagcttgggtacggtccacaacatggagggatcctgatgagtgacaggccgcgcaaagagcccgggccggaccatccgatcaccgtcacaccgaccggccagcgggtcgtggtgaccgtcgccggcaaggtggtggccgacacgaacaacgcgctcagcctgcgcgagtcgacctatccggcggtgcagtacgtgccgctcgccgacgtcgaccgcacgctgctggagcgcaccggcacccggacctactgcccgtacaagggcgaggccggctactactcgatcgtcgtcgacgacgtcaccgcgaccgacgcgatctgggagtacgcggagccctacgacgcggtcgcgcagatcaaggaccacgtcgcgttctaccccgaccgggtggagagcatccggatcggctaggccgccgcccgcagtgcgccgcggaccgccgccaactggtggcggtccgcctcgtacggcgtgtacaacgagatccggtcgatcgtcgcgccgaaccgctcgaccagcccggccgccacggccgccgggtccccggccaccgcgaaggtgtccagcacctcgtcggtgatctcggcggccatcgcggtccagtcctgccgccgggacagcgcgttgagccggtcggccagcgcaccccagccgtgcaggtccagcaccccccgatacgccggtgtggaggcgtagaaggcgatctgccgccggaccgcctgctcggcacgggaccgctcggcctcgtccgcgcccagcaccaccatcgcggccaggcccagctggaagccgtccagtgcgccgccgcgggcctcacgcagcgccggaaccagtttctccgccaggtaggccacgctggacagcgggtgcacgagcaggccgtcggcgacccggccggccaccgcggtcatccgctcccccaccgccgccagctcgaccggtgggttgccgtgcgggttcggccccggatcgaagaactcggtcatcagcgtgtgccggtagaactcgccgcggaacatcagccgctcgccggtcgcccaggtgtgccagatcgcccgcagcgccgccacgaactcctccatccgcgccgccggccggccccacggcatcgcgaaccggcgctcgatgtgcggcttcacctgcgagcccagacccagccggaaccggccgccggagatcagctgcaggtcgttggcgaggatcgcgacggtcatcggattgcgggcgaaggccaccgcgatcccggactgcagcgagatccgctcggtggcccgggccgccagggtcagcgcggtgaacacgtcgtgcttcgtctcggccgcgccgaacccgtcataaccgaggagttccgccgacacggccgcggcctccacctcggcgggcgaggcggcgaccggcgcggagaagtcaaccagcatgcccgtcagcctagggcggcccggatcgccgcggccatcacctccgccgcgaccgcccgcagcagatccagatcggccggctgcgccccggttgccagggccaccacggcgtccccgtcataccgcgaatgggccgggtgcagggcccgggcgaaaccggtgtgcccgctctgcgccagcaggaaacagtcgctcttgctcaaccgcgcgtcggtgaccagcacgccgagcgtggtgttctcccggccgaaggaggccaccggctgatccgtcccggcgccgccgcacaccgggcggccgtccggaccgagcacgtcaccccaggcgttgaccacggccagcgcggtcacccgggccggcccggccgcggcgtccgcccgacccagcccacccggatcggtgcggccccgctagctagctaggctcccgcagctcggccatcacaccgtccgcggcggccaggccgaacgccgagccgccggcgagcaccaccgcgtccacccggtcgaccagccgggccgggtgcagcaggtcgaactcgcgggtcgccggagcgccgccgcgcacctcacccgacccgaccgtgcccggcggcggcaggatcaccgtgacgccggtgccgtcccccgtccagttccccagatgcatccgcccagcctagtaacggaagcccttgaccagggcgctcagctcgccggacatccgggtcagctcggccgtcgtctgctgcgaccgctccacaccctcgctcgtggaccgggccgcctccgccaccccggtgatgttctgcgcgatgtcgccggtgcccgacgccgcctccgagacgctgcggttcatctccgcggtcgtcgccgtctgctcctccacagcggacgcgatcgtcgtctggaagtcgctgatccgcgcgatcacccgggtgatctcctcgatcgcggtgaccgccccgttcgtgtccgcctggatcgcctccacccggcgggagatgtcctcggtcgcccgggcggtctcctgcgccagatccttcacctcgctggcgaccaccgcgaaacccttgcccgcctcacccgcgcgggcggcctcgatcgtcgcgttcagggccagcaggttggtctgctcggcgatcgcggtgatcgtcttgatcacgttgccgatctcgctggaggactcgccgagctggttcatcgtcgccgaggtgcgcgaggccaggtcgaccgcggccccggcgacctgggcggcctcggcggcgttctgcgagatctccctgatcgacgcgcccatctcctcgctgccggccgacaccgtgtcgacgctgcgggagatctcctcggccgccgccgacacggtctgcgcctggctggtggtgcgctccgccgaaccggcgatctcggtggccacctcccgcacccgatccgcggcaccggccagtgaggtcgccgactcgtcgatcgtcgcgacggtgcgccgcaggttgaccatcgcggtgtccagcgcccggcccatctgcccggtctcgtcgttgctggtcagaccggtctgcccggtgaggtcaccggccgccagccgggtgcagacctcccggacccggctcagcgcgccgaccaccgcccggatcaccaggacgccgatcaggatcgccagcaggttgccgagcacctgcaccgtgaggatcacgttccggttggtgtgataggtcgactgcgcgccggccgccgccttctgcgcgtccgccgactcggcctggcccaacgcgacgaagccggccttgatcttgtcggtgatcggcgcggtctgctcgtcccggaccttgacgtacgcatccacgttccggctcagcgcgttggcgatctgggtgttctcgaccacctggcgatacgcgttccagttcgactccagcgcggcgaccgtcgccgcgtcaccggccgggccggccgccttgtaggtggcgagcgtcgacgcgaaaccggtgaaaccgtcctgcacccgcttctcgtacttggcgttgtccgcctcggaccgggagatcagcaggttggccaggtcgttacgggtggagacggcgatcgtctccagggcggccagggtcgcggcgctggtcatgttcgcctggtacagccgctcggccgcggacgccgaccggctcagggcacgggtcgccaggatgccggcgaccagcgacaccaggacgctgatcgcgatgatcgcgccgatcttgtggcggacgcccagatcggcgaagaaactccgccgcgcgggcggctcggtcagggtggtcatcgggtcccccgggacacgctgcgggtggcgagctaaatgatcaattccagacttaaccgtacgaagtcgttccccggcccgggcggtttcatcccctcgtgagtcgccacattcggccctccgcgcgcaccaaccccggcggtcccggcagcccctcctcccgcaccggtcagcgaatccgcgcacagcgtgcggcgggcggtcgcccttcacccacgaccggtcgcatctccatccgcgacggctcacttctccacccgcgaccggtcgcttctccatccgcgacggctcgcttctccaccggcgaccggtcgcttctccaccggtggcggtcaacggatgcggcgcagcgtgcggcggccggagagcacggcggtggcgcccaacgtcacggccagcgccgcgacgaccgccagcagggcgggcaccgccggccagtgcgggcggggcagcggcggcggatccagcccggccagcggcagcgcccaaccggtcaccgccctagctagctagcgcgggccccgcgcagcgcgatcaccgcggtctccgggcggcgcgcctcggccccggccgcggccgccagcagcagggccaggcaggcgagcagcaccagggcgacggccgggaccggcacgatccggcgggcggtcacgtgcccctcgtcgatccgggccagcagcgccgggatggaggtgaccagcttcaggttcgcggaggtgctgacaccgtccccggcgcccaggtcggtgacggtgcggcgcacctcgtcgagcccggcccgcagcgccggcagccggtcggcgtccagcgcgcccggccccgcatacccgtcgatggcgagctgcacgtcgccgtgctccatcgcggtgaccgacgccaggccggtgaaggccggttcgccggcccgggtcccgcccggcgtctcggcgaacgcgaagtagccgtgcgacccccagtacacatcggacgggtcggcgacccgataggtcccggccaggaagaacttcttggccgccccgtcacccacccagagctgcgagtccgggttctgatcgaagcgggcgtacgacaggctcaccgaccgcccggccgccagccgcagccgccgcgccgtctcctcgccgagcaccaggtcaccctcgccgagcaggcagcggccggtcaccatcaccaggtgggcacagacgtcctgccggtgcaccaggcgggtcggtgtccgggcgtcgggttccaggccgacggcgggaaactcggcggcgtacgcataccggaaccccggcaggccgatcagcgaagccccggtcgacgacaggtccacctgcccggccggatccccggtcgaccggcgcgaatccccctcgaccgcctgcaggctgaccgcccgctccgccggatccgccgccgccacctgcccggccgccaccacccggtccgccgcccgcagatacgccggcgccgccaccaccggagccaccgcgaacgcggccagcaccgccagcatgagcgccgccccacctctcgcccgcaccatcgcgagcaccaccgcgatcaccgccgcccacccccaccaagccgccccaccgcgatcaccacacgccttcccgccccggccaccgctcccggccggccggtccgcccggcccccgccgctctcccggccgcaacccggcggcgccccaccgcgcggctcgggtcgaccaccgaacgccacccgccgcccgtaccgaagtcgatcgcgatgccgccggccaacggctggttccgcggtccactcccaagctgacggccgacagccgccctccggcggccccggcaagcggccgtcgcgcccggccccggcccgggtgcgcctagctagctagcggtgaacaccgcggacaccgcgcagagcagcgcgaacggtccggccggggcggtgccccggccgggccggcgagccgcccggccggcgatgctctcgtcgccgagcacggtgaccccggcggccctgagccggtcgacgacgtcgggcggggcgttcgcggtcagccacacctgggtttcgccggccggcgagaactccccggccgtccggcgcaccgtgtcgaagtcgaggaggatcccggcggcgccggtcaccggcagcgcggcggccgtcccggtcacccgggccggcaccggcccggcgcccagcacggtgatctccggctcggcgaaccgccacggcaccggcgtcgggccggccagcagcacgggcagcggcagcagactgtccacggcgaacacccggtcgctgtcggctgtgccgccgttcggcgcggcggtgacggtcagaccgtccggaccgccgctgagttgcaggccgacgccggccgcgacggtacgccagcgggtcgcgtcggccatccgggccgggccgatcagctcggcgtccgggccgagccgggccagcgagtgcaggaccaccgggtcgggcgtgggtttcccgtccgcgccgggcaggctgggaatctcccagcgcagcaaccggcagccgccgtcgcagccgtcgagcggccgggtcacggcgtgctcaccgggcggcaccggcccgaacgacaccaccacccgcgccccgctggtctcgttgagcagcaccgcatcgacggtggccgccgccgtacgcccatttcgcaccttcagcacgagcgaccgcccactgatcacggcggtccccggtgccccatcggtcaccccgggcccagcgcccaccgagaccaccgggacacccgaccgcgatggggccgaagatacctgtggtccttgaggggccgagcccccagtagggacgaacgcggcagaggcggccggcgtgcctggcgaggcatccgtgttcagaggggcttttgtgcccagagaggagacacttcccgccggggcccccgttgccgttgaggccggcgtgtcagcagaggcctttgcgcctgccgaggcgtgggtgccgcgaggggctgccgtgcctgccgaggtcggggaaaccggagcgacagatgtgcctttcgagcctagggtgcccggcggggtcgatgtgcctcgtgaggctgcggcgcctggtgatgtcgaagtgccggacgaggttgcggcgcctggtgatgtcgaagtgccggtcgaggtggccggtcctggtgaggctggcgtgtccggcgagttcggcaggaccgaagggaccggtgattccggtggtgctgggcgcggcccgtactcgggccgccatgcccccaccacccccagccgcccgaaatccaccgcaacggtcggcgggctccccgtccggtcaaccgcggccgccatcgcgtaccgcccggccgggtccgccgcccgcaccgcatgccacagcaccgtccagttcggcacccgcacggtcagcacccgcgccgcaccgagttcggcttcggcgcgttcccggtgggcccgccggtcggcgccggccgctccggccgcggtgaccaggatcgccaccgcgacggccaggatggcgaacacccggtcgagtccggcgagccgggacatccggacggcggccagcccggctagctagctagggccaggtcggcccgcagcggtccggtcgggtcttcgacgtcgccgagttcgccggcccgggcgacgagggcgccgaggtcgtagccgccggcgccgcgcagcagggccggcggcgcctcggccgaccaggtgaggacggcccggccgagctggtcgccggtgaaggtggcggcggcggtgtagatcgggtcggtgccgctgccggtccggtacaactcgtcggcccagtatccggtttccggggcgatgatctcgtagatgccggtgacccggaggggaaggaacggggcggcgctggtcgactggatccggaccaagtcgccgggccgcacgccgaggcgggtggcgaccgcggtggtgagggcggcgtcgccggccgcggccgggcaggtgccggcggtgagccggacccgccggcagaagccggcgcggtagtcgacgttgatcggggtgggcacgccgctggcgtccgtgacgctcatctgccggctgaggccgagcacggttgcggcgccgggcatcggcagggtgcggtcgacggcggcgccgaatccggcgagggtcgcggccgggtcgccctgggtgtcgtcttcccggtgcacggtgatggtgcgctgggcggcggggacgccggccgcggcggcggtggcggcccgttcggtcccggtcagcacgaaccggggcgcggccgcggcgaccgccgccggcagcccggtgagcagcaggagtgtgcaggcttgcgcggcccgggaacgtaccgcgccccacaggatcgtcggcatcaccggttcagcgtggcgcccgcgccgcgcgcgcacccgtcccggcggtcagaccgttatccctctgatatggacagcaccaccgtccggaaacccatgttgccggtcgacgaatcgggggtgttcgacgatcgggcggcgttgcggtaccggttgcagtacgagtcgtggcacaggtaggacccgccgcggatcacccgcgcggcgccccgtgacggcccgcgcgggtcgtcgccgggcgagacggcgtagtaccgcggtgagaaccagtcggcgcaccattcccagacgttgccgaccacctggtgcaacccgtacgcgttgggcgcatacgcccgtaccggcgcggtcgtgacccacccgtcctccgcggtgttgcgtaccgggaagtcgccctgccagatgttgcatgcccagtcgtcgccggccggcaggtcgtcgccccacgggtagcgcagccggtcgagcccgccgcgggccgcgcactcccattccgcctcggacggcagccggcgacccgcccaggtgcagtacgcctgggcgtcgttccagctgacgtgcaccaccgggtggtcgtcgagggccacggtggacggtccgcccgggtgtgcccagtcggcgcccccgacgccgagccaccagggtgtgccggccatccgcccggccacccgttccgggtcggcgaccgccgagtggaagaccgccgaccagccgaagtgctcggcgtcggtgcggaagccggtggcggtcacgaacgcccggaagtcggcgacggtcaccgcggtcacgtcgatcgtgaacccgggcacggtgaccgggtgcaccggttgttcaccgtcggccgggtgcccgtcgccgtgcgcgtcgcccatcgcgaacgtctgcccgggcacgcgggcctggtcgacggtgtgggtgccgcccgcggcgacggccgggacctctcccgcggggcggtccccgccggacggggtgcagcagttcacgtcgatacgataggccgtccgcgccgagcacccgggccgcgtgcgcggtctagctagctagagccgcgccgccgcagcggcaagccgggccgaccgctgcggccggccggtcggctgcggccggcccgtcggctgcgggccggggtcaggcgaagcgcgggacgacctcctgagcggcggcgagcagcggctcgtggtcgtaggcgacccgctcgaagtacaggatcacgtagttcaccccggcctcggccacctgctcgacccgctcgcggatcgacgcgacggtgtccccggtgcgcaccgtgaggctggtcgacttggcgatccggtcgtagtcggtgccctgctcgtcgcagtgccggcggagcacgtcgagcttgtgccggatcacgtccggtttgccgtcacccacgttgctgccgtcggcgtacttcgcgaccagcttgagcgtcaccttctcgccgccgccgccgagccacaggtcgggcttgcgccggccggcacccttcggctcgttgatcggctggtcgatccggtagtgccggccggtgaagctcggccgctcctcggtccacatccggtgcacgatctccaccgcctcgcggaacgcccgcatccgctccggcacgtcggtccactcgtagccgtacgccttccactcgtgctcgtaccagcccgcgcccaggccggcgagcagccggccgtggctggccacgtccacggtcgacgcgatcttggcgaacagcgacgggtgccggtacccgttgcagccgaccatctgtccgatcttgatccggctggtgtcccgggccagggtggagctgaccgtccacgcctcgaaggtggtgttgatcgtcggttccggcacggtgtggaagtggtcgtagacccagaggctgtcccacggcccggcgtcggccagccgggccaccgtggtcatcgcctcgtactgctccaccgggtcgtcgatctcggccagatccatccgccagccctgcggcacgaaaaccccgaactcgatgctcatgatgccaacctatcgatcggatcgccccggcgccgggcaggcggctcgcttccgcttcaccccgatttcccggtacgcacacacctgtcccgccgcgggcttccaccgatcgggttaagtgggtcacccgaggttcactgaacggaagtagcggcttttgtcctacttctctgcagcgctgcaacaccctacccgccgcccacctgggctgacgatctcctgggagcgctctccgtaactttcggtactttcaccggaagcgctcccacggcaaaaccgctgctggagcttaaccggttaacacaattcggtcaggtgccagcgtattgaactggcgggtagccatggcatgatttcggtgccgggaccggaagttgcagacatgcgcccccggcggtaaggagcgcgcccccatggttgccggcaagcaacggatcaccatagcggccatcgcggacgccgccggcgtctcggtgccgaccgtctcccgcgtgctcaacgggcgcaccgacgtgtcgccgcagacccgcgagctgatcgagcgcctgctgcgcgagcacgactaccgccctcgcaactctcggcactccggccgggcccgcctgatcgacctggtcttcaacgacctggacagcccatgggcgctggagctggtgcgcggcgtcgaggacgtgacccacgcggccggcgtcggcaccgtcgtctcccaggtgcaccaccgcaccaccgccacccgccagtggctgcagaatctgcgcgcccgcgcctccgacggcgtggtcttcgtgacctcggacatcgccgagccggtgcacagcgagctgcaccgcctgcgggtgcccgtggtgatcatcgacccggccggcggggcggccaccgacgtgccgacgatcggcgcgaccaactggtcgggcgggcgcaccgccaccgaccacctgatcagcctcggccaccggcggatcgggttcatcgccgggccgaaggatctgctgtgcagccgcgcccgcctcgacggcttccgcgccgcgatggaggcggccggcgtcccggtcgacccgagcctgatggagcagggcgacttccgcaacgagtccggcttcctggccggcggccggctgctcgaccagcccgaccgccccaccgcgatcttcgcctccagcgaccagatggcgctcggcgtctacgaggcggcccgccgccgcggcctgcgcgtcccggacgacctcagcgtgatcgggttcgacgacctgcccgacgcgtgctggtcgtccccgccgctgaccacgatccgccagcccctggcggagatgggggcactcgccgcccggacagtcctgcgcctgtcccgcggcgagacgatcgagactccccgggtcgagctggtcaccaagctggtcgtgcgggaaagcacgaagtccctcgccgagacccgcgctccggccgccgcctgacagaccacaatccacccacggcggccgggccggatccttccaccgccggaaaacccgcaacccgcgccgaagccgccgccggaaaacccacaccccgcgccgaaaccgccgccgggaaaaccgcaccccgccgccggcgatcgagccgggcggcgtatcgggtgcgcggcccggttcgccggctaacgagccggcaccgggccgatgagcggtgtgccgcgaccgcggcacacgctcacttgccgaagccggcggtcaggccgctgagcatctgccggcgccccagcacgtacagggtgaggatcggcagggtggtcagcaccaccgaggccagcaccgccgggatgttgatgttgtactgcccctggaacgcggtcagggccagcggcagcgtgcgctggttcgggtcctgggtcaggatcagcggcagcaggaagccgttccacacctgcagaccctggtagatggtgacggtcatcagggccggtcgggtcagcggcagcgccaggcgccacagtgtgccccactcggtcgccccgtccatccgcatcgactcgaacagctctttcgggatgtcccggatgaagttcgacagcacgagcaccgacagcgggatggcgaacgcgatggacggcaggatgatggcgccgagcgtgtcgtacatctgcagcttgatgatgatcagatagaccgggatgatcaccgcctgcagcgggatcgcgaggcccatcaggaacagcccgttgaccgtgcgcaggaaccggctcaacccgctgccccgcacgatcgcgtaggcggccatgaacgagaccacgatggccggggcgaccgcgccgaccgtgacgatcacgctgttgaagaagtaccggacgaagtcgttctgcagcacgaaccggtagttctccagggtcggcgaggacggcggcaccagcgggttggtggagaagtagtcggactgcagcttgaagctggtgatcacgatccagtagatcgggacgagcaccaccaacagccacagccagccggccagcccgccgaaccagttatactgcagcagccgggagcgccggccggccgggggcgggggcgtgtgcgcggcctgtccggtccgccggctgtcgagcgtggtcgtcatctcagatcccttccagctggctttcggtcgcgtcccggccaccgatccggcgcaccagcagggccaggcccaggccgagcagcaccaggacgaccgcgatggcgctggccggacccatcatcgcggtccggaagccgcgctggtacatgtcgaccgcgagggctcgggtggagtcgccgggaccgccggcggtgagcacccagatcaggtcgaagaaggtcagcgagccgaccaccatcagcgtcgacgatgtgatgatcgtgtatttgagctggggcagggtgatgctgaagaactgccggatccggcccgcgccgtcgatctcggcggcctcgtacatcgcggccgggatctgccggacgccaccctggtagatcagtgagtggaacgggatccactgccaggacaccacgaagatgaccacgccgatcgccagcttgctctcgcccagccagtcctgctgcaggaagccccagcccaggctggcgccgagcccgaagttcgggtcgagcagcatcttgaaggtgatcgcgatggccgcctggctgagcagcagcgggacgaagaacagcaccgcgagcacgctgcggtaccgcttgtgggccgcgatgaaaaccccgagcaggatcgacagcggcgtctgcgccagccaggagagcgccatgatgaggaaggtgaccccgagcgcgtgcggcagatccgggtcggtcagcacggacttccagctgtccagaccggtgaacgggatgttctgggagaggccgctccacgacgagaagctgagcaccagcacaccgagcagcgggatgacgccgaagatggtgaaggcgatcagcgcgggccaggccatccaggagacggagacgctccgcgcgccgcgggaagcggcgggcggagcggaccgcacgacgggcggtgcgatggtcatttgccgatgaccgcgttcatgttggtggcgaactgctgcggggtgacctgcttctggaagagcttggcgatgttgtccagcagcgtctcggccgccgacgggctcagcgcctggtcccaggactggccgaagttcttggccttgctggagacgtcgtagatgaaggtgaggaagtccttgtccggagaggacgccagcttggcgttcgagccctggacgatcgggacgccgcccgagtcgatccagccctgctgctcctggtcgtcgagcatgctggcgaagaacttcttcgcggtctccttctgcttgtcggaggccttggagtagatcgacaggaactgcccggcgttgccgtagacgttgctcgggtcgcccttgccgccctcgaccgccgggaagttgaagtagccgagcttgccgtccttgatgaagctgccaccgtcggacttgatgatgccgtaggaccaggagccgtgcagctccatggcggccttgccgcggtacagcagcgcctggtcggcgttggagtccgcggtgatcgacgagaagcccttgacgaagcccttggcgtcgaccagctgctggaccttggtgagcgcgtcgatcgcggccgggttgctccaggcgtccttctgcccgtcgtaggcgttgccgaagacctcggggccgccgatccggtcgaagagcagctcgagccacatcatgttggtccagcgcgactggccggccagcgagatcggcgcgatgcccttgtcgttgaacttgggcaggatgctgagcagctcaccccaggtctgcggcgggttggccacgccgcacttctcgaacacctccttgttgtagaggaagatgatcggctgcacggtctccgccggcatcgcgtagatcttgccgttcaccgtggccgggccgaacgaggccgggaacagcttgttcttgaccgcggcgttctggctgaaccagtcggtcaggtcgtcgacctggccggcgtcgacgtagctcttgaggccgccgccgccccagccccagatgatgctgggggcctggcccgcgccgagcgccgtcttcagcttgtccttgtacgtgtcgttctggaacgtggtgaccttgacctggttgtccgggttcgccttgttgaaccggtcgaccgcgccctggcggatcggctgtccgggcgggccgctgaggaaccagtaactggcggcgtcgccgctgccggaaccgcccttcgacgagtcggcgggacccgagttgccacacgcggcaagtccggtggccgcggcggcgcccgcggagagactcaagaaactcctgcgtttcacgctgttctccgtactcgaagcatgccgcggggcaccgcggcgggggtgatatagcgatggcgacggcggtcaccgagttccggaactttcgagtgacagccgcaaattaacgcgaggtttcgttaacgtagggtttcgctgcgacgggtgtcaaggcccttgccgtaaccgtgcccggagcgcgagagtaggcgacgtcggcaggccttttcggcaggccggcgcagatcagaaggcccccgaaagtttcgggaaccctccggaggaaacgttgaccacagaacaggtgaccccgccgtggcgcgacccgtcgctgcccgtcgccgaccgcgtcgaggcactgctcgccgcgatgaccctcgaggagaaggtcgcgcagctgggcagtcgctgggtcggcaacgacatgggtgacaccggcgaggaccagggatacgacccggaggagcagcacaacgtcgccccgatgcaggacgtcttcgcggccggcggctcgatcgcgctggccgacgcggcccggcacgggctcggccacctgacccgggtctacggcagcgtcccgcgcaccccggccgagggcgccgccgagctcgtcgagcagcagcgcgtggtgatggcgagccggctgggcatcccggccatcgtccacgaggagtgcctgaccgggttcaccgcgttcggcgccaccgtctatccggccgcgatcgcctggggcgccaccttcgacccggaactgatcgagcggatggccgccgcgatcgggcgggacatggccgcgctcggtgtgcaccagggactgtccccggtgctcgacgtgatccgcgactaccgctggggccgggtcgaggagaccatcggcgaggatccgtacctggtctccctgatcggcgcggcctacgtgcgggggctgcagagcggcggcgtgatcgccaccctcaagcacttcgccggctattccgcctcgcgcggcgcccgcaaccacggcccggtgccgatgggccgccgggagctgaccgacgtggtgctgccgccgttcgagaccgcgatccgggccggcggcgcccgctcggtgatgaactcctactccgacgtcgacggggtgccggccggcgccgacccgtggctgctcaccgagctgctgcgggatgagtggggcttcaccggcacggtcgtctccgactactgggcggtcccgttcctggccaccatgcacggggtcgccgaggacgacgtcgacgccggcgcgcaggcgctgatcgcgggcatcgacgtcgagctgccggacaccatcggtttcggtgccggcctgatcgagcgggtccggcgcggcgagctgagcgagcggtacgtcgaccgggccgcccgccgcctgctcacccagaaggccgagctgggcctgctcgacccggactggtcgccggagaagtcggtggccgcggccccgctcaccgacctgaacgcggccggcaaccaggcgctggccgccgagctcgccgagcgctcgatcgtgctgctggagccgggcaccgcgctgccggtcaccgccgcgggccggatcgccgtgctcggcccgtgcgccgacgacgcccgcaccttcctcggctgttacgccttccccaaccacgtgctcccccgctatccgcagctcggcctcggcctggagatcccgaccgcgctggacgggctgcgcgcggagttcccggccggtgagatcacctacgcccgggggtgcgaggtgaccggggacgaccgcggtggtttcgcggcggcggtcgagacggcccgggacgccgatctggcggtggccttcgtcggcgacctggccgggctgttcggcaagggcacctccggggagggctgtgacgccgcggatctgcggctgcccggtgttcagccggagctgctggaggagctgctggccaccggcaccccactggtcgtggtggtggtctccggccggccgtacgcgctgggcgacctggacggccgggtggccggactggtccaggcgttcatgccgggccaggccggcggcgccgcgatcgccggcgtgctcagcggccgggtgcagcccgccggccggctgccggtgcagatcccgcggcacccgggcggccagccgggcacctacctgcagccgatcctcggggccacgcacgccgaggtgagcaacctcgacccgcggccgctctacgacttcgggtacggccggtcgtacaccgcattcgcggtcggcgatctgcgggtcagcgcggacacggtgccgacagacggcgagttcacggtgaccgtgcgggtccgcaacaccggcgagcgggacggtgccgaggtggtccagctctatctggccgacccggtcgcccaggtcacccgtccggtgcggcagctgtccggtttccggcgcgtcgagctggccgccggcgccgccgcggacgtgaccttcaccgtgcacaccgatcggaccgcgttcaccggtcgtgacctgcggcgcatcgtcgagcccggtgagctgcggattctcgtcggcacctcggccggggacctgccctgctcggccaccgtccggctgaccgggccgacccgtgcggccggcgccgaccgccggttgaccaccggagtccaggtgcggccgatcgcgtcctgacggctggtcgccgaccgcgacggggtgcggagattaggctgaaaccgtgcctccccgcatcaacgacgacgagcggatccgccggttcgaggcggtcaccgacgcggcgttgtcccggctggacgtctcggacctgctcgacgagttgctcgaccgggtccgggacctgctcgacgtggacaccgcggcggtgctgctgctcgacgagcacgcccagcagctggtggccaccgcggccaagggactggaggaggaggtccgggccgggttccgggtggccgtcgggcgcgggttcgccggccgggtggcggccacccggcggccgctgcggctggccgaggtcaccgcggacgacgtggtcaacccgatcctgctggccaagggcatccggtcgctgctgggcgtgccgatcctggcgggcaccgagctgatcggggtgctgcacgtcggttccctcacgccgcggcggttcggtgctgacgacgtacggctgatggagctcgtggcggaccgcgccggcgtggccggccggatccggagcgacaagatggagcaggccgcggccctggcgctgcaacgcagcctgctgcccacccggctgccggaggtgcccggcgtcgagctggccgcgcggtatgtgccgggccacgcggtcggcatcggcggcgactggtacgacgtcttcccgctgcccaccggctggctgggcgtggtgatcggcgacgtctccggccacggcctctcctccgccgtggtgatgggccggatccgcagcgccctgcggtcttacgcgttgatctgcgacaccccggccgaggcgctcaccctgctcaaccgcaaggtgcaccacttcgaggcgggcagcctgaccaccgcgctgtacgggatggtcagcccggagcgggaccggatcgtgctctcctcggccgggcatctgcgcccggtcctggcccgcccgggccacccgggcgggctggccgaggtgccggtcgatccgccgctgggcctgggccggacccggccgcggcgcaacggcatcgtggcgttcccacccggcgcggtgctgctctgctacaccgatggtctcgtcgaacggcgggatcaggtgatcgataccggattggcgcacctgaccggcctgatccgggcggagaatgcggaggcggtgtgcgccacggcgatgagcgcggtggacaccgagcaaccgggcgacgacgtggccgtgctggccgtgcgccggtcgacatgaggcgcggaaaaatgtcttgacccccttgttcgccacggattcagcggaaaagatggggcagcacggactgatcccgaagctggagggcgaatgaccgccaagcagattctgcacaacttcgtcggcggcgccgcggtcgcgcccgccgagggccgatatgcggatctcgtcgacccgtccaccggcgaggtgttcgcgtccgccccggtctccggccgggaggacgtcgaccgggccatggcggcggccgccaccgccttcgaggactggcgcaccaccaccccgagcgaccggcagaaggcgctgctgaagttcgccgacgcggtcgaggcgcggaccgccgacctggtcgccgccgagtcgcgcaacaccggcaaaccgctgggcctgaccaccagcgaggagctgccgcccgcggtcgaccagatccggttcttcgccggcgccgcgcggctgctggagggccgctccgccgggcagtacatgaacggtttcgaaagctacgtccggcgcgagccgatcggcgtctgtgcccaggtcaccccgtggaactacccgctgatgatggcggtctggaagatcgcgccggctctcgcggcgggcaacaccgtggtgctcaagccgtccgacaccaccccggtctccaccgtgatgctggccgagatcgccgccgagttcttcccggccggcgtcttcaacgtggtgctgggcgaccgggacaccggccgcgccctggtcgagcaccggaccccgcagatggtgtcgatcaccggctcggtgcgggccggcatggaggtggcctcgtcggccgccgccgacctcaagcgcacccacctggaactgggcggcaaggccccggtcgtggtcttcgaggacgccgacgtcgcggcggccgccgccgacatcgcggtcgccggctacttcaacgccggccaggactgcaccgcggccacccgggtgctggtcgccccggcgatctaccgggacttcgtggccgccctcgccgagcaggcccgcgcgctgaagaccggcgcgcccgaggacgaggacgcgctgtacggcccggtcaacaacgccggccagctgtcccgggtggccgggttcatcgaccggctgcccgaccacgcctcggtcgaggcgggcggcgcccgggtcggcgaccgcggcttcttctggtccccgaccgtggtggccggcctgcgccaggacgacgagatcatccagaacgaggtgttcggcccggtgatcaccgtccagcagttcgccgacgaggacgaggcggtgcgctacgccaacggcgtcgactatgcgctggcctccagcgtgtggacccgcgaccacggccgggcgatgcggatgacgcagcggctcgacttcggctgcgtctgggtcaactgccacatcccgctggtcgccgagatgccgcacggcggtttcaagcactccgggcacggcaaggacctttcggtgtacgggctggaggactacacccgcctcaagcacgtcatgcacaacgtgggagcctgacgtgtccacctcagccgagctgcaccggcgtcgtctcgccgcggtcgccaagggggtcggttcgaccatcgcggcctatgtggaccacgccgccgacggcaccctgaccgacgtcgacggccgggagtggatcgacttcgcctccgggatcgcggtcaccaacgtcggcaacgccgcgcccaaggtcgtcgaggcggtccgccggcaggtggaacggttcacccacacctgcttcatggtcgccccctacgagtcgtacgtcgcggtctgcgagcagttgatcgcagcgaccccgggcaccttcgagaagcgggccgcgctgttcaactcgggtgccgaggcggtggagaacgccgtcaagatcgcccggcacgccaccggacgcccggcggtcgtggtgttcgaccacgcctaccacggccggaccaacctgaccatggcactgaccgcgaagaacatgccgtacaagcaccggttcgggccgttcgccccggaggtgtaccgggcaccgatgtcgtacccgctgcgcgacggcggcctggacggcgccgaggcggcccgccgggcgatcgacgtgatcgagaagcaggtcggcgccgggaacgtggcggccgtgctgatcgagccgatccagggcgagggcggcttcatcgtgccggcccccggattcctgccggcgctcgcggcgtgggcggccgaggccggggcggtgttcatcgccgacgagatccagaccggcttctgccggaccgggcagtggttcgccgccgagcacgagcggttgcagcccgacctgatcaccacggccaaggggatgggcggcgggctgccgatcgccggggtggtcggccgggccgacctgatggacgcggtgcacgccggggggctcggcggcacgtacggcggcaatccggtggcctgcgccgccgccctggccgccatcgagaccatgcgcgatcgggatctcccggcggcggcccgccggatcgggtcggtcctgctgcccgcgttgaccgccctgaaggacgagggaatcgccgacgtccggggccggggcgcgatgatcgccgtcgagctggtcaagccgggcggcatcgagcccgacccggtccgcacggcggccatctcccaggcctgtcacgcggccgggctgctcacgctgacctgcggcacctacggcaacgtgctgcggttcctgccgccgctggtgatcccggacgccgcgctgcaccgcggcatcgacatcctgaccaccgccttccacgacaactgaggggctttcctttgcccgagcacgtcctcacaggaaagaatctcgccgtgagtgacacgggcctggacgagatcaacaagcagatcatcgatcacctgcagcgcgacggacggatgtcgtacgccacgctcgccaagacgatcggcctgtccgaggccgcggtgcgccagcgcgtgcagcggctcctggacaacgggctgatgcagatcgtcgcggtgaccgacccgctcacgctgggcttcgcccggcaggcgatggtcggcctgcgggtcaacggcgacctgcgggagatcgccgacaggctggccgccatccccgaggtggactacgtggtgatctgcgccggccgctacgacctgctggtcgagctggtctgcaccgacgacgagcacctgctcgacctgctcaacgagaaggtgcgggtgatcgacggggtgaccgccgccgacaccttcatgtatctcaagctcgccaaacagacctacgcctggggaaccagataaaccatgagcttctggctggagacgctcggcccgatcgagcggcgcccacccctgcccggtgaccgggacgccgacgtggccatcgccggcggcggctacaccgggctgtggaccgcgtactacctcgccaaggcccggcccgacctgcggatcgtggtgctggaggcggagttctgcgggttcggcgcgtccggccgcaacgggggctgggcgtccggcctgttcccggtcgccgaggcgaaactggcccggcggtacggcgcggccgccgcccgggccatgcacgccgcgctggccgacgcggtcgacgagatcggccgtaccggcatcgcgtgcgactacgccaagggcggggtcatctcgctgatccgcacccccggccagctgcgccgggccggcgccggggcgatggacgcggcggccgcccgggcgatctgcggcgcgaccggcgtgctcggcggcgtctacagcgagcactgcgcggcgctgcatccggccaaactggtccgcggcctggccgccgaggtggaacggctcggcgtcagcattcacgaggacacccgggtgctgacgctgaccgacggcgaggtcagcaccgaccgcggccgggtgcgctgcggcaccgtggtccgcgcgctggagggctacaccgcggagctgcccggccaccgccgcgatctcgccccggtctactctttgatgatcgccaccgagccgctcccggccgaggtctgggaccggatcggcctgcggcgccgggagacgttcagcgacgaacgccggatgatcatctacggtcagcggaccgcggacgaccgcctcgccttcgggggccgcggcgccccctaccacttcggttcccgggtccgccccgagttcgaccgggtcccggccgtcttcggcagactgcggcacacggtcggtgagctgttcggcatcgacgtgccggtcgccgcccgctggggcggcccgctcggcatcccccgcgactggatgcccggcgtcggcctgcacgacggcatcgcctgggccggcggctacgtcggcgacggcgtggccgccagcaacctggccggccgtaccctgaccgacctgatcctgggccgcgacaccgagctgaccgcgctcccctggaccggccaccggtcccgccgctgggagccggagccgctgcgctggctcggcatcaacggcggcctgcacggcaccgccctgctggacgtcctcgaccgctgacccggtcagcggggcaggcggacgcagaccacggtgccgctcggatcgttggcggccagttggatggtgccgccgtgcagatggatgatggagcgggccaggctgagccccaacccgctgccgtgcgtcccctggtgccgcacgttgctgccgcggaagaagcggtcgaagacccggtcccgctcgtcctcacgggtgccgatcccggtgtcggcgatgcacagctcggcggaggtctcgtcgccgcacagggtgacccggatcggtgcgccgggcgggctgtatttgaccgcgttggccaacaggtcgtcgagggcctgccggagccggtccgggtcgcccggcaccggcagttcgccgggcaggtcggcgctgatcggggcgtgcgcggccgccaccgcgtccccgaccagggcggccaggtccaccggtcgtttcgccacggtcaggtgcccgccgtcgaggccggccaggtcgagcagcgactcggcgatccgttgcagcacggcggcgttgcgggcgatggtgcgggccatctgccggccgtcgtggtcgagcccggccgcctcctcggcgaggatggtggcgttggcggtgatcgaggtgagcggggtgcgcatctcgtgcccgatcaggtcgacgaagtcgttctgcgcccgggccagctgccgggcgagttcctcggcgcggcgcagcgccacgaacacgccgatctgcgcggccaccccgtccatcaggacggtgagcagttcctcgtggcgttcccgggcgccggcataacaggtgagcacgccgagcagggtgtcaccgtcgtgcaccggcacggcgagcacggtgcggatgccgcggcggatgcagatcccgacccgctcccgctcgtacgaggtccgcagatcccggtgggcgctgatgtccgacacccagatggcccggccggtctcccagacccgcccggtgatcccttcgccgcggcgcggcacgtgcccgaagaagtcgtcgtcgggtgcggcgcatccggtgtcccagtgcccgacggcccgcagcccgccgcaggccgcctcgtcgatcacgaacaactcggcgcacggccagccgagtgtctccaccaccgcgcgcagcacctcgggggccgcggcccgcaccgtggtcgcccgtttcagcgcctgttcgacggcgaggtggcagtcccggaagcgttccgcccggtgcagcgcggtcacctcgtgcccgatcgccaccgcgccgagcaccccgccgccggcgtcgcggatcggctgcgcgctgcacgcgaagacccgcaccggctggtccggacactggatcaggacgtcctcggcgacgatgtgctcgccgcgcagggcgcgcatcagcggggtccgctcccaggtcatcggcggccggccgggggtggccaggacccgctcggtgctcgccacgtagtcggccggcaccggaccgtccagcgggaagccgcggacctcgcggatcgtccggttgaccagcaccacccggccgtccgcgtcgcaggcgaccacgcccacggtgaggctctccagcagggcgccgagaaaggcgtcgctgtccgggacgccctgcaccgtcacaccgcgcagcgctgggcgtgcgcgtgcgggccgtgtgccagcaggtcctggatggtggccaggagccgctcgttcggacagggtttgagaagcaccgcgcaggcctcggcgtgggcggcgcgcgggtcgccgggagtgagctggccactgaggatggcgaccgggatgtcggcgacctcggggttcgaccggaccgcgcggatcagttcccagccgtccatccggggcatgccgaggtcggtcagcaccgcgtccgggtgtttctcgacgaccatctcgaaggcggcctgcccgtccggcgcgcgcagcacggtcagcccggcccgcttgcacacccggaccaggacggcggcgatgtcctcgtcgtcctcggcgatcagcagtacggccactccgtcagcatgcgctcaccggtgcgcgcccggggaggtttccgcgcattgccgcgcccaccctatcgagcgctgcgccgcccggtgcggaaaccgctccccaccccggggggagaaacctttccaccgattcgcgggtacgcatgccgctccgcccgttcccaccgagcggatcatcgcgaccatcgataccctcgatcaggtgacgtcacaactaccgatcgtgttcatcgcggccctgggtgaaccgggccggtactggcagcccgtgctggaccgcctcggcgacctgaccaccgtcacctacgaccgtcccgggatcggcgatgcgccaccccgcccggcgccccgcccaccggtggcctacagcgtgctcgccgacgagctggccgctctgctcgacgcccgcggggtgcccggcccggtggtggtcgccgcccattcgatcggcagcctgatcgcccgggtgctggccgatcgccacccgcaccgggtggccggcctgatccacatcgacggctcgatgccccagttccacctgctgcccggcctggagtcgccggaggacggggagaccggcgacccggacgccgcggtgctcgacatcgtggccggccagaccgaggtgctgtacgccgcctcgcccaaggtccccaccctggtgctgacccgcaccccgggcgcctgggacgggcggcatccggccccgcccggcgccgaggagctgtggctggcccaccagcgcgccctggcccgcgacgcgggcgcgccgctggtggtcgccgacgattccggccactacctgcccaccgtccaacccgatctggtggcctacgcgatccgcgccgtgcacaccgccgcggtcaccggccggccggtggagctggatccgaccgccctgcgcgcggccggcgggcaccgcgaccgggccgtcacccattaggctgcgtctatgaccgacagcgggctgagcatcggggagatcgcccggcggaccgggctgaccatcgacaccctgcgtttctacgagcgggcgggtctgctgacccggccggtcgaacgggatgcggcgggccgccgggtgtatcaccaggaggacgagggctggctggagatctgcaccaacctgcgcagcaccgggatgccgttgagcgagatcaaacgcttcgccgacctggtccgggccggcgccggcaacgagggcgagcgcctggcgttgctgcaggagcaccgggagcgggtcgacgagcagatccgccgcctgcagaagttccgcgaggtgatcgactacaaggtcgccgtctacgccgagcaggtcactcagggcaccgccgccacgttctggaccggcgtcggcaccgggtgaagccgacggtccgccaccctcggcgcggcggcggaccggacggatcggggtgggtcagaggcggttccacgcctcggtgagcaccgagcgcaggatctgctcgatctcggcgaactgggtctcggtcgcggtcagcggcggcgccagctggatcaccgggtcgccccggtcgtcggcgcggcagtacaggccggcttcgaacagggcgctggacaggaagccgcgcagcagccgctcggactcctcggcggtgaaggtctccttcgtcgccttgtccttgaccatctcgatgccgaagaagtagccgtcgccgcgcacgtcgccgacgatcggcaggtcgagcagcttctccaggtaggaccggaacagcgggctgttctcccggacgtgccggttcaggttctcccgctgcatgatgtcgatgttggccagggcgacggccgcgccgaccgggtggccgccgtaggtgatgccgtgcgcgaaccagttggtgccgtccaggaacggctcggccagccggtccgaggcgatcatcgcgccgagcgggacgtacccggaggtgaggcccttggcggtggtgatgatgtcgggctggtacccgtaccggtcggcgccgaagaactcgccgagccggccgaacgcgcagatcacctcgtccgagacgagcagcacgtcgtaccggtcgcagatctggcggacccgctggaagtagccgggcgggggcgggaaacagccgccggcgttctgcaccggctccaggtagaccgcggcgaccgtgtccgggccctcgaactcgatcatctccgcgatccggtcggcggcccagacgccgaactgctcgggtgtcatgttctcgtcgggccggcggtagtagttggtgttcggcacccgcatggtgctcgggatcagcggctcgaagtcctgtttgaacggcgggatgccggtgatcgacagggcgcccatcgaactgccgtggtacgccaccgcgcgggagatcaccttggtcttgagcggcttgccgatccgcttgaagtacgaccgggccagcttccacgaggactcgacggcctcggagccaccggtggtgaagaagacccggttcaggtcgccgggggccatctcggcgagccggccggccagctcgatcgccttggggtgcgcgtacgaccagatcgggaagtaggccagctcggcggcctgcttggcggcggcatcggcgagctcctggcggccgtgcccggtctggacgacgaacagggcggagagcccgtcgaggtagcgccggccggcggagtcccacacgtagcacccgtcaccgcgggtgatcaccggcaccggggcgtcccggtaggcggagagccgggtgaagtgcatccagaggtggtcacgggcggtcgcggagagtgcgtccacgtcatcaggctgtcggtcggtcatgtctcccacgctcagttccgtactcgttcccgttgttggcaccgatcctgcctacggaatccgtggtgcacaacccctcaggcaaccatttccacgttgaatccgcgttgggctcccggcatccgaaaagcgccgaccccgggaccggggccggcgccgaagaatccactacgagtcgaagcccagcccgaatctgtccaacgtgcgcagccacaggttgcgccgtccgccgttgcggtcggcctgcgcgatcgacctccgggtcacctggatgacccacgagcggatcggctcgggcgggaacggcaccggcttgcggcgcaccatcttcaaccgggtcagcggcgtctgctctccgccgagcaggtcgagcatcaccttcgcgccgaaccgggtggcccccacgccgaggccggtgtaacccaccgcgtacgccagccggccgcggaacgcggtgccgaagaacgcgctgaaccggctgcaggtatcgatgatcccgccccacttgtgcgtgaaccgtacgtcggccagctgcgggaacgtctcgtagaagtgctcggccagcagccggaacgtctcctcgcgcaggtcccgctcgggggcgatccgaccgccgttgtagtacaccgcgtcgtacccgccccacaggatccggttgtccgcggtcagccggtagtagtggaactggttggccgagtcgccgacccccatccgctgccgccagccgaccgcggccagctgcgccgcggtgagcggctcggtgatcagcgcgtagtcgtagaccggcacgacccagtggcgcagccggcgcagcagctgcccgtgcgcgccggtggccagcgccacctgtctcgcctcgagccggccccgccaggtgtgcagccgcagcacgccacgcttcgcgctgatcttctccacccggctgttgtcgtagaagcggacgccgagctcggcgcacgcctcgcggagtccccagaccagccgggccgggtcgaccagcgcggtggagtccacgtcccacaccgcgccgaggtaggtgggcgagtcgatctccgcccgcacctcgtcgcggtcgaacctgcgcacgttgagcccgcgctcccgggcctcgtcgtaatactccagaagctcctgcagctgccagtcggtggtggcgacgttcagctctccggtccgctcccagtcacagtcgatgtcgtaccgccggaccgtcgcctcgatctcgtcgaggttctccaggccgagccgttcgagcaactccatctcggccgggaagcgactgatgccgttgtcgaagccgtgggtgagactggcggagcagaatccgccgttgcggccggaggccgcccagccggccgtgccggcctcgatgactaccacatcccgttcaggatctcgttctttcgccaggagcgcggtccacagtccgctgtagccggctccgatgatggcgaggtctgcctgtgcgacacccgtgaggggttccgccggggccggggcgccgtcctgcatcagccagtacggctccccgatcgcctcggcgaggggggtatggaagggatctcccataaaatatcagtcccgttttgatgtggatcttgatcgaaggttggcgatgaccgcgatcagcacgccggccgcgaagatcagcgtgcccatcacgttgacctgcgggggcaggccgacccgggtggctccccagatgtacagggggaacgtggtcgcgctgccggagacgaagttggtgaccacgaagtcgtcgatggacagcgcgaaggcgagcatgaagccggagaagatggccggcaacagaatcgggaaggtgaccttccagaacgtcgtccaggcggtggcgccgaggtcggccgcggcctcctcgatcgaccggtccagggtgatcacccgggcccggaccacggtggtgacgaacgagatcgagaacagcacgtgaccgatcacgatcgtcgccacgccccggccggtgttgagcgagacgaacaggctcagcagcgaggcacccatgatcagctcgggcgacgccatggtggcgaacagcaacaggttgatcgtgcccgacccgcggaactggtagcggcccagcgcgtacccgatgccggtgccgaccgcggcggcgagcagcgagctgatcaccgcgatgaccagcgacaaccacagcgccgaggtgagctcgtcgagcccgaagatgtccttgtaccacttgaccgtgaagccctgccaggtctggttgaacttgccgtgcgggttgttgaacccgaacaggatcatcacgaagatgggcaggaccagccagaggatgaccagccaggtgtaaccgaacatcaggctggcgccggtgatccggaaccgacggcgcggggccgcgccgggggcggtgacgggtggggtgagcgtcgaggtggtcatcgtgccgccgcattcatgacgtcctcggtgccgagcgcccgcgcataggtgaagacgccgaccagcagcaccgccatcagcacgaaggacagggccgaagccgtcgggtagttggaactggccaggtactgcgcctggatcacctggccgatcatggtggtgctggcactgccgagcacctgcgagttgacgtagtcggcgctggccggcacgaacgtcatcagcacaccggcgaagaccccgggcagcgcgagcggcaggaccacccggctgaacacgaccggcggcttggcgtacaggtcgcgggccgcttccagcacccgcgggtcgatccgctccagcgccacgtagatcggcaggaccatgaacggcagcgagttgtagaccaggccgaagatcaccgcgtacgaggtgccgaggatgtggaagccgggtgagagcagcccggcctccttgagcggatgcagcagcaccccgtcgtcggtgaggatctgccgccacgagatcgtccgcagcacgaacgacacgaagaacggcaggagcagcaggaagaggtacgtcgatttccgcttcccgccgtggaacgcgatccagtacgcgatcgggaagctcatcacgaccagcaccaccgtcgtgatgagcccgtacaccagcgagcggatcaactgcacccggtagtcggagatggcatccacgtacgtctgccaatgaccggtgaaccggtagccgttgatgacgtcgccctgctgcagggacagcgagaacatggtggccatcggcaccacgaagaacagcagcagccacaacccgccgggtagcacgagcaggtagggcgcgagtgtgcgttttacccggttcatcagctcagctcaatgtgatcggttcgaagatgcgctggaagttctgctgctcttcctgcgtgttgaagtcgatgtagtagtgcagcttgtcgtagtcggactgccccgggaacaccagcgggctgccggccaccatcgtcagggtcttcttgtcgtccccgctcgcggcggccgcgtccttcttgatctggtcctgcgcggccggcaccgggcacacgtagttgatgaactcggccagcgacgccgcgttctccacctcgtagaagaagtccatcatcatgatcgcgtcgaccgggttggccgcggtgatcgggatcgtcatgttgtcggtccagatcgtgccgccctcctcggggatcacgaaccggaagtccgtgccgtcggagacgttcttctggaagatgtcgccggaccaggcctgggtcagccagacctcgcccttgcccagcgcgtcgacgtagctctggtcgtagtagttgcggaccatgcccgccgacttctgctgcttgagcttctcggccgcctgcttccactcggcctcgccggagccggccggcttgagaccggccgcgagcagaccgaagttggccagttcctgggtgtcggagaacatcccgaccttgcccttgaactgcgggtcccacaggtcggcgagcttggtgatctcccggccggtcttcttgatgtcgtacgcgatgccggtgatcccggacgcccacgggatgctgaagacgttgcccgggtcgaaagcctcgttggcgtacgatttaccggcgttcgccgcgtagttgggcagcttcgagtggtccagcggggccaggaagccgccggagcggaactggccgaactgcaccgagttggtgatcaccatgaggtcgaagccgatcgactgaccggccgacagctggggctgcaccttggcgaaccagggccccatctcctggatgacctcctggtagttcaccgtgatcccggtcttctcggtgaacttcttgagctgcggcttcttcgggtccatgtagagcggccagttcgcgaagtcgagcttgccgttcttgaccttgccgctccagaacttcgccacggcgtcgggggcgacgctggcctccggcttgcccttgccctgcacgccgcaggcggccagcaacgctccgagagccgacgtgccaccgaggcgcaacgcgtcccggcgaccaaggcgccgctgcgtcatgccgcgcaggacggaggggtccggctgactggtcgggaacatcagactccgatcgggtacgagtgctggggggcccaggtgaggaagacacgctcgccgcgcgaggcgacgtcctcggcatcgtgagcattctgatcgaacaccacgaagtctgatcccgcggaggtcgcgaccgtgtagttggtcgatgtcccgtggtagacgacctcggtgacggtgccggagagcaggctgccggtgaccgcctgcggggcgctccggtgcaggtcgatcttctccgggcgcaccgacacctccagcttccggccggcctgcaccgtgccgggcaccggcgccaggatccgctccccgctgcccaggtccagtacggcgaacccgtcctcgacccgggccacctggccgtcgacgatgttcgacgtgccgatgaagccggccacgaatcgggtcgagggccgctcgtagatctcccgcggcgtgccgagctgctcgatcagcccggcgttcatcaccgcgatccggtccgacatggtcagcgcctcaccctggtcgtgggtgacgtagacgaaggtgatgccgacctcgcgctggatccgcttcagctcgatctgcatctgctggcgcagcttcaggtcgagggcgccgagcggctcgtcgagcagcagcgcccgcgggtggttgaccagcgcccgggccagcgcgacccgctgctgctggccgccggacatctccttgggctgccgcttctccatgccggtcagcgagacgatctccaggatctcgccgacccgccgcttgatctcgctcttggcgaccttcttgcgctccagcccgaacgacacgttctgcaggacgttgaggtgcgggaacaacgcgtacgactggaagaccatgttgacgtcgcgcttgttgggcgccacgttggtgacgtccttgccgtcgaggaagaccgtgccggtggtcggctgctcgaagccggcgatcatccgcatcgtggtggtcttgccgcagccggacgggccgagcagcgagaagaactccccctgaccgatcgccaggtcgaggctcttgacggccgggaccgcctcaccgtgcgacaggtattccttgcggacaccggcgaactcgatcgccgggtacccggtccgctcgccggtggccggcgcggccttcgcggcgtggtgcgggacagacgtggtcataaatgttcacctcggaggcgggggtggcgattgtccagcggatcagcggatcagccgtgatagctcatcacgtgcttgatccgggtgtactcctcgaagccgtacagggaaaggtccttgccgtggccggagtgcccgtaaccgccatgtggcatctcggacacgaacggcaggtgcgtgttgatccagaccgcgccgaagtcgagacggcgggacacccgcatggcacgaccgtggttctgcgtccagacgctggcgctcagtccgtagcggacgtcgttggcgtaccggaccgcttcggcctcgtcggcgaacggctgcaccgtgatcaccgggccgaacacctcgtcctggatcatctcgtcgcgctgccgcaggccggccaccacggtcggcgcgaagaagtagccgcggtcgccgatccgccggccgccggccaccacctcggcgtgcgccggggtgcggtccaggaagccggccacccgctccagctgggccgcgttgttgaccgggccgaagaacgccgcggtgtcggacggggcgccgacccgggtgccgcgggccgcctcggccagcgcggcggtgaagtcggtggcgatccgctcgtgcaccagcacccgggtggcggcggtgcagtcctggccggcgttgaagaagccggcgccggcgatcgcggccgcggtggccgcgatgtcgacgtcgtcgaagaccacgaccggagccttgccgcccagctccaggtgcaccttcttgaggtcgggggcggccgccgcggcgacctccatcccggcccgggtggagccggtgatcgacaccagctgcggcaccgggtgggccaccagcgcccggccggtgtcccggtcgccgcagaccacgttcagcacaccggccgggaggaactcggcggcgatcccggcgagcagcagcgtgctgaccggggtggtgtcggacggcttgagtaccaccgagttgcccgcggcgatcgccggggccagtttccagatcgccatcaccagcgggtagttccacggcgtgatctgcgcgcacacaccgatcggctcacggcgtacgtaggaggtgtggtccctgaggtattccgccgcggccttgccctccagcatccgcgccgcgccggcgaagaaccgcaactcgtcgaggaccgggcccatctcctcggcccgggtcgccgcgaccggcttgccggtgttgcggcactcggcctcgatcagctcctcggcccgcgcctcgaccgcgtcggcgatgcgcagcagcgcccgctgccgctcggccggcgtggtgtcccgccagacctcgaacccggcggtggcggcctccaccgcgacctgcacgtcccgctccgaggagaccggggcgagggcgtaggcctcgccggtgctcgggtcgacgaccggcgacgtccgcccctggtcggtgtccgtgaaggatccgttgacgaagttgcgcagcacggggagttcggtgctcacgggggtgttgccttccgtcggtgtggtgacgctcaccagaagtgggggaaccttgtcacatccttgacggatgtgacaagggaatccgaagtagtttccaatccggaaacagaaatcagaagcagagtggctcaggatccgtagaaaccgtcggcaaccgtcaacgcctcgtccaggatggtgagaccctcgcggacctcctcgacactggtcgtgcagggcgggaccacgtgcacccggttgaagtgggtgaacggccagagcccccgctccttgcaggccgcggccacctcgttcatcggtccggcggccgctccggccgcgttgaacggcaccagcggcgtccggtccgcgtccttcaccagctcgatcgcccagaacacgccgaggccgcggacgtcgcccacgctcgggtgcttctccttgagctcggccagggccggggcgatcacctcggtgcccagcatccgggcgtgctcgacgatcccctcctccttgaagatctcgatcgaggcgaccgcggaggcacaggcgagcggatgaccggaataggtcaggccgcccgggaacggccgctcgcggaacgtctcggcgatctcgtcggagatcaccaccccgcccagcgggaggtagccggagttgacccccttggcgaaagtgatcaggtcgggcaccacgccccagtggtcgaccgcgaaccactcgccgcaccggccgaacccggccatcacctcgtcggcgatgaacacgatgccgaactcgtcgcagatctcccggacgccggccaggtagccgggcggcgggaccaggatgccgttggtgccgaccaccgtctccagcaggatcgcggcgatggtgcccggcccctcgaagacgatggtgtcccgcaggtgctgcagcgcccgccgcgactcctgctcctcgctgtcggagtggaacggcgaccggaacgggtacggtccccagaagtgcacgacaccgaccgcgaccggctcgttcggccagcgccgggggtcgccggtcgcggtgatcgcggtggccgtcgagccgtggtagctccggtaggtggcgagcaccttgtgccggccggtgtgcagccgggccatccggatcgcgttctcgttcgcctcggcgccgccgttggtgaagaacacccggttcagcgagccgggggcgagctcggcgatcagccgggccgcctcgccccgcttgtcgttggcgaaggccggctggatggtgcagagccgggccgcctgctcctggatcgccgccaccagccgcgggtgctgatgcccgatgttgatgttcaccagctgggacgagaagtccagatacctccggccgtcgtagtcccagaagtaggaaccggacgcgccggcgatcggcagcgggttgatcaagccctgcgcggaccaggagtggaagacgtgcgcgcggtcgtccgcgcggacctgagcctcagacatagtacgaatcctcaccgagtctgcgggaagccgaggtcgatcgccgaggttccgggatcgggccaccgggaagtcacgaccttgccacgggtgaagaagtggatgccgtccgggccgtacatgtggctgtcgccgaacagcgaggccttccagccgccgaacgagtagtaggccaccggaaccgggatcggcacgttgacgccgaccatgccggcctcgacgtcgaactggaaccggcgggccgcgccgccgtcccgggtgaagatcgcgacgccgttgccgtactcgttctcgttgaccagccggaccgcctcggcataggtgtcgacgcggaccaccgacagcaccgggccgaagatctcgtcggtgtacacggtcatgtcggtggtgacgttgtccagcagcgtcgccccgaggaaatatccgtcctcgtccgcgatcgccgacttgcggccgtcggcgatcaccgtggcgccggcctgttcgccggcggcgatgtagcccgcgacccggtccctgtgctgggcgctgatcagcggccccatgtcgacaccccgatcggccccgttgccgaccctgatcttcggcagccgggccgcgatcgcctcgaccagcgggtcggcgatgtcgcccacggccaccaccaccgagatcgccatgcaccgctcgcccgccgccccgtaccccgcgttgatcgccgcgtcggcggccgcgtcgagctcggcgtccggcagcacgatcatgtggttcttcgcgccgcccagcgcctgcacccgcttgccctgcgcggtgccggtctcgtagatgtacttcgcgatcggggtcgacccgacgaagctgaccgccgcgatgtccgggtgcaccagcagcgcgtcgaccgcctccttgtcgccgttgagcacggtgaagacgcccgccggcaggccggcctcggcccacagccgggccaaccagagcgccgcggacgggtccttctcactgggcttgaggacgaacgcgttgccggcggcgatcgcggtcgcgcacatccagagcggcaccatgaccgggaagttgaacggggtgatgccggcgaccacgccgagcggctgacggatcgagtacacgtcgacgccggtggcggcctgctccgagaaggcgcccttcatcaggtgcgggatgccggtggcgaactccacgttctccaggccccgggcgatctcgccggcggcgtcggccagcaccttgccgtgctcggccgtgacgatcgcggccagctcggcggtgcgcccggccagcagctcgcggaaggtgaacagcaccgcggagcgccgggacagcgatgccgcgcgccacgcctcggccgcctccttggcgaccgcgacggcctcggcgacctcgtcggtgccggccagggcgacctcggcggtctgctcgccggtggcggggttgaagaccggggcgacccggccggaccggccggcacgctccgcgccgccgatccagtgcgcaatctgattcatgcggccgagattatgtgacgaccatggaccgaacaatgcttgaaatgtactgtaacaaaaatgttcgaggcgatcttcgcgagactcaccgaccccagcgcacgcggcctggccgaggcgctcagccgggcgatcggcgacggcgcgatcgaggccggcgccaaactccccccggtccgcacggtcgccaccgagctgcgcctgtcgcccagcacggtcaacgcagcctggcagctcctgcgccgggccggcaccatccggacggacggacgccgcggcacggtcgtcgccgcccccggctccggcggccccgggcgttatcgggcggccctgcgccgcgccggcggcttcggcctcgacctgtccaccggcgtgcccgacccgcgactgctcccgccgatcccggcgctgcacggcctctcccccaccccgaccagctacctcgacgagccggtgctgcccgagctggcggccctgctccgcgaccgctggccctatcccgccgaccgcctcgccgtcttcgacggcgcgatggacgcgatcgaccaggtcgcgtcgtcgctgctgcgcctcggcgacctcgcggtggtggagaacccctgcttcccgcccctgctcgacctgctcgaggtgctcggcgtcccggtcatcggggtcggcaccgacgccgagggcatgcttcccgcgcagctcgccgccgccctgacgcggcgcccggccgcggtgttcctgcagccgcgggcgctcaacccgaccggcgcgtcgtggtcaccgtcgcgggccaccgccctcgccgccgtcctgcagaaaacgcctgaggtgtacgtcgtggaggacgactccgcgggcgacctggccgccgggcccctgtcgtcgatcggcgtccacctgccccgccagacgatccacgtgcgcagcttctccaagtcgcacggccccgacctgcgcctggccgcggtcagcggccccgccggcgtcctcgacccgatcctggaacgccggctgctcggccagggctggaccagccgcctcctgcagcggctgctgctctgcctgctcaccgacccggcctcggtggccgcggtggccgccgcccgggacgagtatgcgcggcgccgccgcctggtggtcgacggtctgcgcgcggccggcatcgacctgcccgacggtgaggggatcaacctctggctaccggtcgccgacgagcaggccgcgctgctcagcctggccagcgccgggatcggggcggcggccgggacggcgttcacggtcggcccgggctcgccccacctgcggatcacggtcggcctggtgaccaccgaccacgccgccgtcgccagccgcctggcccacgccgcccacaccctggccccggccatcccccgttgactcacctagccgagtaaccacttgccccgcgacaactaggcatgggatgctcgatgcatgagcgcatgcgacactcttcccatgagccaggtcacgctcccttatcacgaaggcccctggtccgaggatgactacctcgcgctcggcgaaaccgaccatcgcatcgagctgatcgacgggagcctctgggtgagcccggcacctaaccgaccgcaccaacacatttccgcattcctctggctggctctgcaagcaacagcgcgaacggctgggttccaggttcttctcaccaccaaccttcgactggcgacgggacgcatcctcatccccgatctggtggtggacaacggtccgcccctcgaaattgtcggggaggcaaccgacgcggtcctcgtctgtgagatcacctcgccgagtaacgccacctcggaccgcatcttgaagagggcactctatgcggaagccggcgtcccgtggtatttgctcgtcgagccggatttcagcgactacgcatcgctgacgctgcgcctgttccggctgaccggccgggaatatgtcgagcatgccctcgccaagcagggtgaaacactccgctcgcggttgccatttcccatctcgatcagcactgacgatctgatcagtccttggcgggaatgaaactcttgaaaaccacttcgaggacgtccttctcgtatttggcccagtcggcgtccggggtctggaaccagaagccgtaggcgtggtgggccgacgtcacgaccccccggttgttgacgtgctggacgccgttcttccggaaagtccactcccagtcggcggccttcacgaaataggagaccgactcgagcttcttctcgtcgtacccggggaagtcgccgccgcgcaggcgcgtatcccgctgtgacttccagtccgccaccggatccgaccttgggtggtcggtctggtcgatgccgagcacatgccccttgccgtcccgccagtaccgcatcgacgatccggaactcttcgacgtcgtccagccctccggcacgtacaccgagaagccggtcgcatcgtcgtaaaccttccacccggccggcagcggcggacgcccgttcgccggactcggactcacgctcggaccgccactcaggctcggactgacactcacgctcggcgtcacgccggccgaacccgccgccgacggctccgcgccggcaaccgcgatcgcggccgtcgtcgccggggccggcccggtcgtcgtcctcggcgacggacggttgaaccagaacaccgcgaatcccgcgagcagcaccacgatcagcgcgccgaccagcaagatccgatttccgcgtacgccgtcggtcgcctgctgcaccgtgtcatccaccggggtgcggggcttcggcaccgaccgggaccgctccaggtcggcgaccgcccgctgcagcagccgctccgcctccgccgccacgatccgctcgtccggatctttccgcagcaacccgtccagcaccggggtgagcgggccggcgtgctgcggcgggtccggctcctcggtggccagcgcggccagcgtcgccatcgtcgacgcccgctggaacggcgaatggccctcgaccgcggcgtacagcgtcgcgcccagcccccacaggtcggccggcggcccactcaccccgtaccgcgcgcgctccggcgccatgtacagcggcgagccgagcagcacatcggaccggctggtcaggctgtcgtcgtcgatcgccgcgatgccgaagtcggtgagcagcacccggccgtcgtcggcgagcagcacgttcgccggtttgacatcccgatgctgcaccccggcccggtgcgccgcctccagcgcggccagcaggtcgaggccgatccgggcggcccggtacgcgtccagcgggccgtccgactcgatcacctcccgcagcgagcgggacggcacgtactccatcacgatccaggcgcgatcgtccagcgagagaacgtcgtacacctgcaccacgctgggatgactcaaccgtgccgaagcccgcgcctcgcgcagggtgcgccgcgtcgcgtcaccctcggcgagctcctccggcaggtccagcagtttgaccgcgacgtcgcgttccagggtctcgtcccgggccagccacacctggcccatcccgccgcggccgagctcggcacccagccggtatcgtccggcgagcagggtcggcgcgtcaggcatgtccttggacataccctccccgggcgcctccgcaacgtccgccgcctccgcggccgccgggcgcggtggatctgctggggagttcatcgagcctgccgttctgggccggggggatcagcgacggatcatcctcgcacgcccgcgataccgttcccgcgtggatcacgagaccgccatcaccgccgcactcgccgccgccacggtcattcgggatcggtacggccgcagtctagaccgcgtcgacaagggtggcggggacttcgcgaccgcggcggatctcgcggctgaacaggccattcacgacgttctacgggccgcgcaccccggcgatgcgatcaccggcgaggagaccggcgcctccggccccaccggcgcccggcgccgctggctggtcgacccgctgtgcggcacgctcaactacgcggcccgcaccccgctggtcgccgccaacgtcgccctccgcgacggcgcccacctcaccgccgccgcgagcgccgacccgttcaccggcgaaacatactggacggacggctcgtcagcccggctgcgtcacccggacggcaccgacacaccactcaccccttcgggcgagtcggccctggtcgacatcaacctcgaccccccgttccccaccgaaccggcccggatcgtcgccacccccggcttccgcgcccgattccgcccccgggtgatgtccaccaccctggccctgctctgggtgtcggacggtcgccgagccgcctacctcacctacggcgacgtctccgacagcgtccacttcgccgccggcatcgccatctgcgaagccgccggctgcgtggtcaccgccaccgacggctccccatggcagaccggccgggggctgctcgccgccgccgaccccggcacccaccgcgacctcctcgccctgatccgctccacctgatccgctgcccctgttgcgtctcttccttgacggctgcccatcaccgctttcccgtcatcggccgggccgacgaaaaggccgggcctgccggcttcagccggccggcccggcgaattcagggtcagcgggaacgccggatcagggccacgccggccgcggcagcggcgaggaccgcgccgaggagagcaaactccctgggccgcgcaacgacccgccgacgagccgaaccgatcgccgcggaagcccgctccgccgcatccgccgcctgacaccccatccgcgcactggtctgcgcggtcgcctcggcgatccgacccgcaccgtgcgtcttctccccggcgcccggctcccgcagtttcgccatcgccgcggccctgaccgactccgccccactcgcagcggattccctcagctcaccggcagcctgcgtcatcgcctccttggcgtggctgccccgttccacggccgactccttgatctgggccgccttctcccgaacctcgtccttcaccgcgctcagcccgcctccggcgaccgctcccccgccgccactgaggttcccctcggcaatcccgccgccgggcttcgcctccgcggccccgccgccgggcttcgcctccgcagccccgccgccaggcttcgcctccgcggccccgccgaccttggcagccttgtccttgatctgcccagccgccccgatggccgcgtccttgacatgcgcggccttttccgcagccgagtccttcagctccgcagccgactccttgacgtgggccaccttgtccgcagcggcactcttgacccgccccggaacgtccaccttcgccaccagcgcctcgaccgtctcccccatctcggccctggtctgctcgatctcgttccgcagttcatcggcatcccgcggcgcgccggaactctgcgccttccctccggtccccgccaccggcttcgcgcccgtcccctgcttcgcctgcaccgccatggaactccctcccgaactctcggccttccgcatcccgtcatgtcccgccccagcgtccggccctgcccccggcgcaccaccgtgcccggccggcccaccaccgtgcccggcaagctcaccacctcgggcccccggctcaccacctcgggcccccggctccccaccgcgggcccccggctccccaccgcgggcccccggctcatcagccgcggcctttccggtagcagccgccgaggcactctctgccattcccgacgcagcgcccttcgcctccgccgtcgccgggtgctgcgcggattccaccttcgcggccggcggcacagaacgctccgccacctccggcacggaacctcgcccagatccctccgtcgcagcccgcgaccccgaacgctccgccgcctccggcgtgacgtccttgacctggccctggacaggctgggacgtggaacgctgcccggtcgccgatgcgctccccgtcaccgggcccttcgcaacctgggatgcagcacgcgcctccgctttcggcgcggtgccctgcggcccctccgatccggtgcccccaattgcctgcgccggcgcactcttggccggcgccggcgtcttctggcccggaccaggcttcggcggccccggcttcgggacggcacccggcgacggcacggagctcgaaggccccggatgcggtttcggccgcgagtccgccgccgacccgggatgcggcctcggtcgcgaatgcgctcccgcctcggaatgtggcctcgggcgcgagtccgccgccgacccggaagccgactccgccgagccggctggggcgggcttggtgggaaccgaagcggcaggaccgggcttcgggctcgccaccggcgacgacgcagccgcgctcggcgacgcgccagggctcggcttcggagtcgccaccggcggcggcgcggcggcaccgggactcggcttcggggtggcggcagtaggtgaagcggtcgggctcggcttgggtgggccgggcttcgcggtcacccccggagcgtccaggccggtggtcttcggagggccgggcttcggtgtggtggcttgcggcgcactgctgccgacggaccggctcccggcatccgacggggtcgtcgccgacgtcgaggtggagcccgacgtcgaggtggggtccgaaggcggcggggtgggcctgggcggtgcgcccgcgctggaaggtttgccgctttgggggccgcccggggtggtgttgccgcgggcagtgccggtcggcgccttaccggccgggccgccggtgggggtcttgccggccgcggccggggtgacggcctctccagcccgggccgagccgccggtaggcgccttgccggccgcggccggggtgacggcctctccagcccgggccgagccgccgataggcgccttgccggccgcggcggaggatggggtggcggtctcgccggggcgcgccgagccgcctgtcggggcgtggtcggtcaccggctcctcccggtgcgggcggcggtcatgaaggcgtcgacgtcttcccggccgctggccatcgcttcctcgggttccggaggcagagcgtcgcgaacctgccgacggccgacgagtgcggcgatgccggcgccggcgaagaggaccgcggtgacgatcagggcggccagccagaccggcatcgccagggcgagcgcggcgcccgcggcgaccagcagggcgccggcgccgtacatcgccaacactccggcggcacccagcaacccggcgcctttgccggcgcgtttgcctttctcgaccatctccatccgggcgagcgtcagttcgtcccgcaccagggtcgacacctgctcgctgagccggctgaccagttccgcggtggtggcctgctcacttcgtgcgtctgtgtgcgccatcgtgcccctccgtcctgcgcagctttccgcaagtcacgtacccctacgaaacctgcctaaccacccccaaccccacacccgcagacgctcccagatccggcgaaccggcaacccgcccccgacagcctgaccaactcggcagaccgattgacgccggcgaggcccagcatcgccgagcccggcccggcctggggcgcagcgcaggacatggcgcagcgcaggacgcggcgcagcgcagggtagggcgacgcggcacgggcggcgcaggcctagctagctagaggcgcagggcggcgcaggcgcagggcggcgcaggcgcgccgctcaattcggtgaaggacggcggtaaacagcgcgagccaggccggattgaaacgtctcacgacaggtatcggatctggagctgcggccgcggacgctgaagaacaaggccagatgcaaggtcagcccagtgagaagatgcccgaattgtcccactctgggcgtgcagcacggccgaccgccggcaatcccgaagcccgccccgccattgaaacgtctcagagcagctcctcgcagcccttgaccgccccgaaacccaaccgtaacgtgtcccgcaccacagatagaacgtttcaagtcgccggaggccgtcgatgcgttcccgactcccctttgccctcgccctctccaccgtcgccgccctggcggtctcgggatgcaccaagaagaacgacaccgacggggcccccagcggctccggtgacaggaagacctacaaggtcgccttcgtgccgaagctgcagggcgtcccctacttcgaggcgatgaacgccggcggcaaggccgccgccgccgcgctcggcaacgtcgagtggctctatcagggcccgacgcaggccgacgccggggcgcaggccgacatcgtccgctcctacatccagcagaaggtcgacgccctgatcgtcgcgccgaacgatccggattcgatggccccgctgctgcaacaggccaaggacgccggaattcacgtggcgaccgccgacaccgacgcgccgaacagcgtgcgggaggtgttcgtgaaccaggcgaccgccgacggcatcggtcaggggctgaccgacgcgctgctcaaggcgatgggcggcaagggcaggtacgcgatcgtctcctgcggccagaccgcggagaacctgaactcctggatcagggtgcagcaggcgtacaccaggcagaagtatccggacgccaccatcgtggacaccgtctacgccggggaggaccaggcgaaggcgacccagatggcgaccgacctgatgaacgcgcacccggacctgaccgggctggtcggcgagtgcacgtccagcgcgcccggggtggcccaggccgtcaaggacgctggcaagatcggcaaggtgttcaccgtggggctgggcacgccgcagtcgatgaagccgtacctgaaggacaggtcgtcgtcggccgccatcctctgggacgtgcagcagctcggctacctgaccgcgtgggccggtgcgcagatcgcccagggcaagccgatccaggcgaccaacgacgtcagcgacaagctgccggcggtcacctacgacgcggccggcaagatgctgctgctcgggccggcgctgcagatcaccgaccagaacgtcgaccagttcggctactgagccgatgacgacggggacaccccggctccggctgtccgggatcgccaagcgtttcggtgcggtgcgggcgatccagcaggcggacctggtcatccgagaaggccgcgtgcacgccctggtcggggagaacggcgccggcaagtccacgatgatcaaaatcgtgtccggggcggagaccgccgacgcgggcacgatcgagttcgacggcgagccggtccggatcggcggtacgaacgacgcgatcgccctgggcatcgcgacggtctaccaggagccgcagctgttcggcgagctcacggtcgcggagaacatcttcctcggccgcgagatcacgagagccggacggatcgactgggcggcgcagcaggggcgggtggccgagctgctggagcggctcggcctcccggcccgctccgcgaatgccgcggtgaacaccctgtcggtggccgagcagcagcaggtgtcgatcgcgaaggcgctggccaccgaggcgcgggtgctgattctcgacgagccgtcggcgatcctcaccgacgccgagatcgacgtgctgttcgacgtggtgcggcggctgaccgcggcgggggtcgcggtcatctacatctcgcaccggctggacgagctgttccggatcgccgacgaggtcaccgtgatgcgcgacggcaagaccatcgggacgtacgacatgagcgggctcaccgtgcgccggatcgcggagctgatggtcggcggggtcctctccgacgagcgcccgcaccgggtcgtcccggacggcccggccgtgctggagctgcgtggactgggccgggccgggcggttcgccgacgtcgacgtgacggtccgcggcggcgagatcgtggcgctgtacgggctggtcggttccggtgtctcggagatcgcggcggcggtgtacggcatcgaccggatcaccgccggcgagatccacatcggtggggagcgggtcaccccccgctcccccgcgcacgcgcagcggctcggtgtcgcgctgctgccggccaaccgcaaggtcgaggggatattcggcgtccagtcgatcgccttcaacatctcggccgggcacctgcggctgctctcccggttcggcacgttgctggaccgggggcgggagcgcggtgtggcgctggacctgatcaggcggctgtcggtgaagacgccgagcgaacggcagccgatcagcgcgatgtcgggcggcaacgcgcagaaggtggtgctggcccggcagctggtcgagcggccgagggtgttgatcctggccgagccgacccagggggtcgacgtgggcgccaaggaggagatccaccggatcgtcaccgagctggccgacagtggcacggcggtgctggtggtgacctcggatctgccggaggcgctgcggatcgccgaccggatccaggtggtccgcggcggcaccacgacgatgtccttcggcccggacgccagccaggtggatctgttggcagcggcggcgggaggcgacgagtgaggaaccgggtcaccggccaggagctggtcctggtcggggtgatcgcggtgctctgggcggcgctggcggtgggcaccccggcgttcctgaccgccggttcgatccagccgctgctggtcgcgaccgccccgaccgccctggtcggcgtcggcatgaccatcgtgatcatcacgggcgggatcgacgtgtcggtcggcggcgcgctcatggtgtgttcggtgctgaccgcgaaggcgctggtcggcccgggggtcgaccccggtgtcgcggtgctgctcccggtcgcggtcggcggcgtgctcgggctggtgaacggcctgctgatcgcctacggccgggtgcacgcgatcatcatcacgttcggcacggcgaacctgttcctcttcgccggcctgcggatcttcgggtccgggacggtcaacgggatccccggcacgctcgcgttcttcgggcgcggcgcggacgggcgcaccctcggtgtcccgcacgccttcctgatcaccgtgctggtgaccgggctggcctggtggtatctgcggcacaccgcgggcggccggcacttcttcgcgatcggcggggatgcggtcgcggcccgcctggcaggggtccgggtgcaacggcgggtgctcatcgcgtacgtcgtcaccggtctgctcgtcggtctcgcctcgtgcttcgtgatcgcgcagggcacctcgacgctggatcagtcggtcggctcgggccgggagctcgcggtgatcgcggccgtggtgatcggcgggacgtcgatcatgggcggccgcgggtcggtgaccgggacgctgctcggggcgctgctggtgcagtcggtgagctccggggtgacccagctcggctggcggtcgcagctgtccgacctgttcgtgggcgtgttcatcatcgtggcggtgggtgccgacctgctgcgcgcacgggccaggaggagtcgatgagccgggtcgtcaagatgctgctgacgcagcggatcgcgctgctcgcggtgctgatcgtcgccgtggtggtgacgttcttcatccaggacgcggggggctacctgaccgcgtcgtacgacttcgactacatgtccgccgcgctgatcaacgcggtgccgctggcgatgctgggcctggccgagctgctggtgatcctttccggacgcggcggcatcgacctctcggtcggcgcgatcgtctcgctggccggcatggtcttcggtttcgcgtacgggcactggggctggccgctcggggcggcgatcctcctgaccgcggtctgcggggcgctgctcggcgcgctcaacggtttcctggtctcctacatcgggttcccggcgctgatcgccacgctggccacctactacgcggacaagtcgctggccatcgtgatcaacgatcagcagccgatcagcaccaccccgatccagcacctgttcgcgatcagccgctcggtggagctgccgctgttcggccggtacgtgcccgatgtgccgctgggcgtcttcaccttcctgctgcccaccgtggtggcggtctggctgctgctggcccgcaccgcgtacgggcggcggctgtacgcgatcggcaccaacgacgttgcggcgcgctggtccgggctgccggtgcgggacacccggttcaaggcgtacgtctacgccggtctgctcgccgggctggtcgccgtggtcaccgtcggccagttcgcctcggcccgcccggacgccggggtgtccggcaacgggatggcgctgccggcgatcaccatcgcggtgctcggcggggtggcgatcaccggcgggatcggccgggtggccggcgtggtcctggccaccctgctgatcgtctggctgaacgccgggatcctgctcgccttcatcggcaacgagggctcgcagtaccagctgttcgcgctcggcgccgtgctcgtcttcgcggccctgctcaacgggctcaccaaccgccgctacggaggcacgtcatcatgaacctggacgacctggacggcttctccgtcgaagtgcccagctgggcctacgggaactcgggcacccgtttcaaggtgttcaccgcgcccggagtcccccgcgacccgtacgagaagatcgccgacgccgcgcaggtgcaccggctcaccggcctggcgccgcgggtgtcgctgcacatcccgtgggaccgggtcgacgactgggcggcgctgcgcgcccacgccgaggggctcggggtgcggctgggggcggtcaactcgaacctgttccaggaggacgactacaggctgggttcgctctgccacccgaacccggcggtgcgcgacgaagcggtcgggcaccatctgcgctgcatcgagatcatgcacgagaccggatcgacggacctgaagatctggctgccggacggactgaactatcccggtcaggactcgctgcgcgggcggcaggaccggctcgccgatgcgctccggcggatctacgacgcgctcggcgacggccagcggatcctgctggagtacaagttcttcgaaccgtacttctacagcatggacatcccggactggggcacctcgctgctgcactgcctggccctcggggagagggccacggtggtcctcgacaccgggcaccacgcgcccggcaccaacatcgagttcatcgtgatgcagctgctgcggcagggccggctcggggcgttcgacttcaactcgcgcttctacgccgacgacgacctgatcgtcggctcggccgacccgttccagctgttccggatcatgacggagatcgtggcggccggcgcgcaccggccgtcgtccggggtcaacttcatgctcgaccagtgccacaacatcgaggagaagatccccgggcagatccgctcggtgctcaacgtcgagcaggcgctggccaaggcgctgcaggtggaccgggacgcgctcgccgtcgcgcagcgcgagggggacgtgctcggcgccaacgaggtcctgatggcggcctacgagaccgacgtgcgcaccgcactcgccgaccggcgggaggcgcgggggttgccgcgggatccggtcaaggccttcaagatctccgggtacgccgtgaccaccgccgccgagcgggccgacggcgccccggccggctggggcgcgtaggcggctcgctacccggggcagcgccgggcgtattcgtcggccagggcggacacggcgcgcaacgctccggcggcctcggtgcggatcaggccggccgcggccgccgggtccacgacgccaccggcgcgggcctggtcctcgaccgaggagcagaccgcggccagggcggcggcgccgatgttcgcggccgagcccttcaacgcgtgcgcctcgtcccgcgtcaggccgggatcatccttggtgagggcatcgagcaggcggtcgacggcgtcgggggtcttggccgcgaaggatcgcagcaggcgcagcaccagagcgatctcggcgggtgacgggtccggttcggtgatggcatcgatccgggcccggaccgtggcgagccgttcgtcctccatccgcccatcctgcttcccggcagccgggaccagggtcggattcacattcctgctcagcggtgccccgcgtaggcggtgggctggtagctcgcccggtaggggacggcggcgagcaccgtctcgatcagttcgatggcgcgggcgaagttggtcagacggtcgagcatcagctcggtgatcacggtttccttgccgatcagcaccagcccgttggtcgccaccacgtcctcgatcagccgcatccccacctcgagctcggtcacccgcacgctcttgacggtgtccttgaccgcccggacccccttgagtcgccgcagcgccgccacgacatgcgggtagtgcccctcgcgctcctcgatcgcggtgatcgcgtcgaccgcgttgactccgcggctctccagcatctcgtagtcggtcgccgtgcgcagcacggcgatcgcgtcctcggccagcgccgagcgcccctcggccggggtcggcgccccggtcagcccgcgcacgatggccagcacctcgcccatcatcgggatgtcgccgagcagccgcagcgcgatccgcggcatggcgtcgaccgaggcctgctcgtccgcgctgagcggcagcccgcgttccaccttggtgagggtggcggccggcacggcgaccgcgccgagttgcgcggccatcgcggcgacctcgatctcccagaggccgtcgagctgcaggaggtggcagagttcgccgaccagcgtgctgatccgcccggctcgccggtaggccggcgggttggacagttcgagcaccccgaagagtgctttcacgctggtccgcagcgtccggtcgagcagttcccggtcggcgatcgcctcgtcgtgcttggccaccgaggcccggatcgcgtcgcgcagcgcgtccgtgtcggccggtttgggcaggtagcggtagacgccgccggagttgatcgcggcgaccgcggtgctcatgtcgccgtggccggtgtgcagcacccgggtgatgtccgggtattccatctggacccggcgcagcagctcgatgccgttcatcccgggcatccgcatgtcgctgatcaccgcggcggcccggccgtgctcggccagcaccttcagcgcccgctcgccgtccggcgcggtgagcacgttgaactcccgcccgagctgcagggagagcgcgtcgagcacggtctgctcgtcgtcgacgaccagcaccatgggtttcttgtcgtcggcggccgccgacttgtacagctcggtccgcacaggtcctcctcaaccttggtgccgcaccgtatcgacacggtgggacgagccctgagcgttacgtcaaaacctcatgccgggccggtggccgccgaagtcaccttctgtgcgccggagatcccgccacctcgtgccctggagacgatgcagatgagcgcagtcggtgacgcggcccgggtcgcggcggtgcgcagctaccagttgctcgacgcgccccgcccggtggtcctggacgagctgacccggctggccggctcggtcttcgagacctcgatgtcgacggtgaccctggtcgaggcggaccggcagtggttcgccggcagcaccggcatgccgagcagcggcgggccgctgggcagttcgttctgcggggtggtggtcgatcagcggatgccgctggtggtcgccgacgcgctcacccacccggtcttccgcagctgggagaacgtggtcggtgcgccgcacatccggttctacgccggggtgccgctggtcgacgaggacgggttcaccctgggcaccatgtgcgtgctcgacgaccggccgcgggacaccgcggaccggcggctggacatgctgcacacgatggccgggcaggcggccggccacctgtccggtgtccgcaaccggatgctgctggccgaggtgggtgacgaactgtcccgggcgatcagccgggaggaggatttcgtcgccaccgtgtcgcacgagttgcgcaccccggtcaccaccatccagggctacctggaactgctggtcgacaacgaggagctggccccgtaccgcaggatgatcgaaccgatccagcgcaacggcgagcgcctggtccggatggtcgaccacctgctggccggcacccgtccggtcggcaccccgctgccgctgctgcgggcgcagaccgacctggtcacggtggccgaggccgcgatggccgcgtgccgcccgcaggccgcgcagcgtgacgtgtcgctggtgctggaggtggccgggggcgccgggcccttcccggtgcccggcgacttcacccggctcagccaggccgcggagcacctgatccgcaacggtgtgctgttcagcccgcccgggtccacggtgcgggtgctggccgacgagttcgggctgagcgtggcggacgcgggcgcgggcatcccggcggacgagctgccgcacgtggccgagcggttcttccgcggccggttcgcccgggagcaggcggttcccggggtcggcctgggtctggcgatcacccagcggatcctgcgggcacacgagggcacactgaccgttatgtccgacggatcgggaatgggcaccaccacgaggatgaccgtgatctcctgacaacatgcggatcctgcggcgtctacggctcggtggccgcctgtcggtggccttcgccgtcgtgctggtgctgctcggcgtggcggtcgcgatcggcgcggtcgggctgaaccggcagtccaccgcggccgcggacaatcgcgacctgatgcgtctgcagcaccaggtcgaccagcagaaatacttcgacggggacatctccgggtggcaggtcgcatacgcctgggacacccggcgcggcgatccgcggaaggcggtcgacccggccagcgagaaccgcgccggtttcctggccgacgcacaggcgctgcgggacctgctgcgggccaccgacaccgggcggatgaccccggccgagcgccagctcttcgacaccctctcggccacctgggacgagtatttcaaggccgactcgcaggcggcggccctgtacgccaagggcgacgtggcgggcggcgacaaacagatcctcggacccggatacgacctgtacttcgcgatcgtgcagggcaccgacaaactggtcgccgcggtcaccgggcgcgccgagcaggccacccgcaccgcccagcggcaggcggccaccgcccggaacgctctgatcatcgcgttcgccctggccgtggtcgcggccgtgctgctcaccgtggtggtcacccgcagcgtcaccggcccgatcggccggctgatcagcaccctgcaggcgatggcccgcggcgacctgacggtgcgcgccgacaccgacggcggcgacgagatcgcggtgatgggccgggccgtcgacgaggcgatcaccggcatccgcggcagcgtcgtcgagatcgtcgagagcggggtgcggctcaccgaggcgtccgagacgatgcgccgggtcagccaggagatcgaccaggcggtggcggaggccgatcagcaggccgggctggccgcggcgagcgcctccggggtgtccggcaacgtgcacacggtcgccgccggcaccgacgagatgggctcggcgatcagcgagatctcccgcaacgccggcgacgccgcgcaggtcgccacggacgcggtcgccgcggcccgggccaccagcgccaccatcaaccggctcggcgactcgtcggcgcagatcggcgacgtgatcgacgtgatcaccacgatcgcggcgcagaccaacctgctggccctgaacgccaccatcgaggcggcccgggccggcgaggcgggcaagggcttcgcggtggtcgccagcgaggtgaaggacctggcccaggagaccgcgcgggccaccgagcagatctcccagcagatcgccgcgatccagagcgacaccgggcaggcggtgaccgccatcgacgagatcagccggatcatcgagcagatcagcgactaccagaccacgatcgcgtcggccgtcgagcagcagagcgccaccacggccgaaatgaaccgcggggtgaccgaggcggcgaacggcgccagcgacatcgccggcaacatcgccaacgtggcgagcagcaccgcggccagccgtgcggcggccggtcaggccgcccggacggcgcacgaggtggagacgctcgccgagcagttgcggtccgctgttcagcggttccgcatctgagggcgccgtacgacggtgccggcccgccggtcgctcaggcggcaccccgatcgggcgccgacagcagggccagtaccccggtggcctgcatggatcggtgcacgatgccctgcgcgccgaccacctggcaggtggcgccccgggtctgcgcggcggtccggatgttcaccagggcgtcgatgcccgacgagtcgcagaaggtcagcccggccacgtccaggatcagccgacgcacgcccggggtggccagcgccgcctcggcctcggcggtcacccggccggtggtggccaggtccagctcgccgtgcagggccaggcggaccgcgcccggaccgtcgtagcggacgatcctcatgcgacgtccccgcgggccgagccggacgccatcggcgtgccggcgccggggcagggcaccagccgcacccgcacctgtttgccgccctcgtggttgtgcaccgtccagccttcggcgagcgcctcgatcagggcgatcccgcggccgccggcgccgtccgggtcgcgccgccggggcaccaccgaggaaccgtcggcgaccgacacgatcacccggcggtcgtgggcctcgacctgcagggcgacgcagccgccgccgtgccggaccgcgttggtgaccagctcgctgaccaccacggcggtcacatccagccagtcggggtcgtcgaaaccccagccaccgagaacggcgaccaccgcgcgccgggccgcgccgggtgcgccgtggtgcagagggacgtccagataggcggtcaacgcactcatgcaagaaactccgcgagtcgccgatatgcgggcggagggtacccacgaacggcgggtgacgaaacctgaacggcgctgtcgtctctttcaaccatttacgcggcttatgtcggcctacagtacggtgatggcagcggtgctggtcgtcgaggacaacccggaacatcaggcggtgctcgccgagatcgtccgccggctcggccacagcgtgacggtcgccgatgacggccgggccgggctcgccaccgccctcgccgagccgttcgacctgatcgtcgccgacgtcgacatgccgcacctggacggggtgcggatgtgccgggcgctgcgcgccgcgccggccaccgccgacgtgccggtcgtgctgatcaccggctacctgccgcccggcgacacccggctggccgaggccggcgccgccgcggtggtacccaaaccgttcagcgtccgggagctcaccgagaccctgcgcggctgcctgccggtgccggccgacgggccgttcctgtccgagctgatgcgcagcctggacagcggggcggtggcctgcgaccgacacggccgcatcgtgttcgtcaaccgggcggtccgcgacttcttcggcgacgagtgcgccaccgtgccgatccgggaatggccgcgccgcttccagctgcgccaccacgacgggaccccgctgcggccggacgagatggcgctggagcgggcgctgcacggcgaaccggtgcaccacgccgacgtgcggaccagcgaccggcagcggcggccgcgctggctgaccgtcaacgcccggccggtgcgcgacgcgtccggagccgtgctcggggcggtcgccgcgatgcacgacgtcaccggcgaccaccagcagctgcggtacgagaagtgcaaggccgaggtactgcacgcgctggtgcacgcccgggaggtggaacacgccggcgcggccgtgctgcgcagcctgtccacctgcctggactggccgtacctgcggttctggctggtcgacgaggtgtccggccggctgcgcccggcggtcacccacctctcccccggtgccgaggagatccccctcccgcccagcctgcgccccggcgaaggggtggccggccggtgctggacgaccggtgagctgatctgggtggccgacatccgggccccggactcgccggtgatggcccaggtcctgggcaccggataccggtcggccggagcggtcccggtgctcagcgccgagcaggtggtcggcgtgctgaccttcttcaccccggaccggcaggatgcggaaccggcgctgaccgtgctgctcaccggcgtggccgggctgctcggcgcctacctggagcggcgccgctcggacgaactcgccaaccagctggcggccagcatcggggagtacatcgcgctggtcgggcacgagctgcgcaccccgctcacgtcgatcgccacctacaccgacctgatcgccgagtccggcgacgacaccaccatcggcgaggtccgcgacctgctcgcggtcatcgaacgcaacaacgcccggctgcgcaccctggtggaacgcctcctcgacctgtccgccctggaatccgggcacgccgggctgaccgtcggcaccgtcgacctgtccgcggtgctgcgcgacgcggccgccgcggtcaccgccgaggccggcgacggcggcgcccgggtccgcaccgacctgccggaccgcctggacatccccggcgaccaggcccgcctgcggcaggtcgcggagaacctgatcgggaacgcggtcaaatacagcccgcccggctccaccgtgacggtcaccctgaccgccgactcggacgccgcggtcctggtcgtcaccgacaccgggatgggcattccggccgaggaacgcaatcgcctcttcgcccgcctctaccgcgccaccaacgcccggcacagcggcatccccggcgccggcctcggcctggcgctgagccgagccatcgtcgagctgcaccacggcacgatcaccctgaccgcgggccacccggacggcaccatcgccaccgtccgcctccccctgaccgccaccgactagcccggccagcccgacctgccaaccccggccagccccggccagcccggcctcccgaccccggccagcccgacctccttgccacgggcagcccgacctcccggccccggcaagcccgacctcccggccccggcaagcccgaccttcgcgccccctcggcacggcgatccccgaccggcgtcaccacactccgacgctccgcgtcctccggccgcaacgcgccgcgccggctccggccgtttcagcagggcccgtggcctccgaacgcggaccgtgccgcccatccgcccgccgatacgggcaccgcgcggtgcccggccagcgggccggcgatgtacggcgcgcggtcttccgcgcgccggtgggccggctacgcgcggcgcgcggtttcccgcggcggatcggtgacgaagccgggtttcggtgaccacccgcgggtgcagcgccggagggccgagcgttgtggacgcgtagcggccagctcggcccggaggtgccctcggcgggagcggcggtctgtcatcggccgcagcgcacgacatcaggatcttgaagttgatcgtgcccttcatccggagcgcaaggttgatcgtgaccgcaccccgggcgcaaagttgatcttgatgatgtccgccgttccgggcgctaaagttgatcttcatcaccctcgttccagttgccaaggatgtgcaacagccacccaccgctaatatgctgactccgagagggggcgccatggacgcgcaagcgatgcacatcgcgaacgggatcgtgaacgggccggtctccgccgccttcgtcgtgctcgccgtcgcggccctcgccgtgtgcgtgtggcgggcgcgggccgatctcgacgatcggctggcgccgatggccgggctggtcgcggcgttcatcttcgccgtgcagatgttgaatttccaggtgctgccgggcgtctccgggcacctgctgggcggcacgctcgcggtcatcctggtcgggccgtgggtcggcgcgctctgcgtctcgaccgtgctgatcgtgcagtgcctgctgttcgccgacggcggcctgaccgcgatcgggctgaacatcacgaacatggcgctgctcggcaccgcggccggctatctgctggtcgccggcctgctgcggatcctgccgaagagtccggccgggctgggcgcgaccgcgttcgtcgcctcggtcgtctcggtggtggtcgcctcgcagggtttcgtcctggagtacgcgctgggcggcaccaccgacctgtcgttgccgtggatctccggcacgatggccggggtgcacgtgctgatcgggatcggtgaggggatcatcgcggcgaccaccgtgatgaccgtggcccgggtgcggcccgacctggtctacgcgctccggaaattccgcaagccggtggaggtggccgcgtgaaccgcaagcttttcctggccgcggggctgctggtcgccctgctgctggccggcgtggtgagcaatttcgcgtccggcagcccggacgggctggacgcgacggcccggcagggctgcacattcgacgcggccggccggatcaccggcgggcactgcatggcgcagcgggagcaggcgcatcagatggcggacagcccgctcgccgggtacggcatccgcggcctgcaccatgcggcgctgtcgaccgggctggccggggtggccggggtgctgatcacgttcgggatcgggctgggcgggttctggctcgtccgccggcggaaggtgtcctgaggatgggggcggggcactcgcatccgctgtatctggaccggcggggccccctgcaccggctggcgcccgaggtcaagatcgtggcggcgctgctgttcacggtggtcgtggtggtcacgccaccgacgctctacgccgccttcctcggctacctcctcctggtggccctgctggccgccgccgcccgggtgccggtggggtggctggccaaacgcgccagcatcgagctgccgttcgtcctgctcgcgctggcactgccggtcctcgggcacggcgcacgggtcacctggctgggcctgtcgctgtcggtcgacgggctgcacggggcgtggaacatcttcgccaagggcaccctgggcgtgctcgcctcgctgctgctggccgccaccaccacgatgcgtgacctgatcctcgggctggaccggctgcgggtgccgtcggtgttcacccagatcgccacgttcatgctgcgctacatcgacgtgctcgccgacgacgcccggcggatgcggatcgcccggctgtcccgcggctacgatccacggttcctgtggcaggtcaaggcgttcgcggtcggcgtgggttcgctgttcctgcgctcctacgagcggggcgagcgggtctacctggcgatggtgtcgcgcggctacaccgggcggatgccacagctgaccgggccggtcgcgccggccgggcagtgggcggtctccgcggtactgccgctgctcaccgccggcatcgcggtcgccgcgggggtgctcggatgaccgcgctgcggatcaccgggttgcactactcctacccggacggccgggccgcgctgcgcggcgtcgacctgaccctcgccgccggcgaacgggtcgcgctgctcggcccgaacggcgccggcaagaccactctggtgctgcacctcaacggcatcctgcacggcgggggcggacaggtcgaggtctccggactgccggtcaccccgggcgaccgggccgcgatcgccgaggtccgccgccgggtcggcatcgtcttccaggaccccgacgaccagctgttcatgccgtcggtcgcggaggatgtcgctttcggcccggccaattgcggcgtacgcggcgccgagctcgaggcccgcgtcgacgaggcgctgcgggcggtcggcatggccgagcatcgggatcaggtcccgcatcacctgtcgttcggccagcgccgccgggtggcggtggccaccgtgctggcgatgcgcccggagatcctggtcctggacgagccgtcgtcgaacctggatccggccagccgccgggagctcgccgagatcctcgagtcgctgccggtcacgctgctgatggtgacccacgatctgccgtacgcgctggagttgtgcccgcgctcggtgatcctggacgcgggccggatcgtggccgacggtgcgacgtccgcgctgctggccgaccgggacctgatgcgggggcaccggctggagttgccgttcggcttcgacccggtggccgcggtcagaggacgccgggagtccggcgccctctgagcgggatcaggcggcctcggccagcgtttccgggcccgctgcttccggacccgtttccgggccggcgatgatggcctgccaggtctgccggccgaccacaccgtcggcgtcgagacccgcccgggcctggaaggcgcggaccgccgactcggtctccgggccgaactcgccgtccggcaccgactcccggcggaacttgtgttggaccccggcgaccgcattgccctgggcgccgggtccgacctccttgatcagcgccagccacgtctccgcgcagacgatgccgttgtcggggagacccttcgtgcgctgataggcgcgtaccgcatcaccggtctgggcgccgaagacgccgtccacggtgaccgtgtgaccgtgtgcacgcagcaggtattgcagcgtgggcacgggatgttgcgtcgaaccctgtcgggtcgtcggccaagggctgagcgtaccggccatccggggtccccttcctcaacgtcgagtaggcgtgtgtcattcaccttcgcgtcatccggcgtcgaaagaaagggtgaagtatctctccgcccacactttgtaaggcggagaggcactcaaaccctcctagatcaactttgcgcccagtcctggagtgaccaatcccgcacctcgggcatgtcctccaggtgctccaccacgtaggtcgcgtgcttctccagctgcgcctcgcaccacgccttcagctccgacgcgccgctcggcagccgcctcgcgttgttgatcgcgtcgatcaccaggtggtagcgggacgccttgttgcgcaccgtcatgtcgaacggcgtggtggtggtgccctgctcgatgaagccgcgcacccggaaccggtcggcgtccggccggccgtgcaccagctggtggatcgcccccgggtagccgtggaaggagaacaccacgtcgacgtggtcggtgaacagctcgcggaacatcgtctcgctcatgccgtgcgggtggtccttgggccgcggcagcgtcatcaggtcgaccacgttcaccacccgggtcctcagctgcggcagccgctccatcaggatccgcgcggcggccaccgtctccatggtgaccacgtcgccggcgcaggccagcacgatgtccgggtcgctgttgccgtcgtcggtgccggcccactcccagatgccggcccccttggcgcagtggtcgatcgcctggtccatgtcgagccactgcagctgcggctgcttgtcgatgacgatcaggttgatgtacgaccgggagcggaagcagtggtcggccaccgacagcagcgtgttcgcgtccggcggcaggtagacgcgggcgacgtcgccgcgctgggtgagcacgttctggatcagaccggggccctggtgcgagaagccgttgtggtcgttgcgccaggcggtcgaggtgagcaggatgttgaggctcggcaccttggcccgccagggcaggtgcgaggcctcctgcagccacttgccgtgctggatcgtctgcgacgcgctgaccatcgcgaaggcctcgtaggtggcgaacatgccgtgccgcccggtcagcgtgtaaccctccagccagccgtggcagttgtgctcggagagcacctccatcacccggccggtggggctgagctgcacgtcgtccggggtgacggtctccatgaaggcccggtcggagacctcgaagacggcgccgagccggttcgagttcgtctcgtcggggcagaacagccggaaccggtcgtcgttgcgcgtgtagatgtcgcgcatcatctcgcccagcttgcgggtcgactcggcgcgcccggcggccggcgtcttcacctcgaccgcatagtcccggaagtcgggcaggtccagatcccgggtgagccggccgccgttggcgtgcgggctggcactcatccgcaggtcgccctcgggcgccaggtcacggaccgggccggtgggcgcaccggtggcgtcgaacagctcgtccggccggtaggagcgcagccactcctcgagcatccgcaggtggtccgggttgtccttgaccccggagagcgggacctggtgggcgcgccaggtgccgcccacggtcaccccgtcgaccgtctgcgggccggtccagcccttcggcgtgcgcaggatgatcagcggccagtgtggacgccggccgtccccggccccgccgcgcgccgccgcctggatggcccggatccggccccaggcctcggccagcgcctgcgcgaaccggtggtgcatgccgggcaggtcgtcgccgccgacctcgatgatcgcgtaaccgtggccctccaggagcttgcgcacctcggccggatccttgcgggccagcacggtcgggccggcgatcttcgcgccgttgaggtgcaggatcggcaggaccgcgccgtcgtgctccgggttgatgaacgagatgcccttccacgagccctccaggggcccggtctccgcctcgccgtcaccgaccacggcgatggtcagcaggtcggggttgtccatcaccgagccgaacgcgtgcaccagcacatagcccagctcgccgccctcgtggatcgagccgggcgtggtcaccgatacgtggctggggatgccgcccgggctggagaactggcggaacagccgcagcagcccctcctcgtcctgcccgacccgggggtagacctccgcataggtcccctccaggtagcccgcggcgaccagcgccgggccgccgtgccccggcccggccagatagatcgcctgctggccggtggtcttgatcagccgggagacgtgggcgtagatgaacgacaggccggggctggtgccccagtgcccgagcagccggggtttgatgtgctccggcttcagcggctcccgcagcagcggattgccctgcaggtagatctggccgacggtgaggtagttgttcgcccgccaccaggcgtcgaggctcgcgacctcggtgtcgtcggggtgggccagcctgcgcaccaggtcctcatggtcgagcacagcggtcacgatctttccttcccggaaggcttcgtcgatgctcactcttctcggccaggaccctgccgggcagggtccttcggccccttcgagcgggacgatacccccgggatcagacgacattccgggtcgtcgacgtgaactaccgggtgacccgctcccgcaacgcggtcagcgcggtcgcgtacatccgggtcttgatcgtgccgagcgtgtcccccgcgttcggggccagcgtcgcggcgagccgcaccgcggtcggcagcaccgcttccgcctccaccgcctggtcgacgatcgccgcggcccgcgcgtcggtcccgccgtagcgccggccggcggtcatcgcctcgtgggccacctgcggtgccagccgtccctggatgagcgccgacatgcccggcgtgaacgggatgctgatgttcacctcgggcaggcaccagaacccgcggtcggcccgcatcacccggaagtcgtgcgtcagcgtcagcatcgccccggccgcgaacgcatgcccctggatcgccgccacggtcggcagcggaagagcgagaaaccgggcgagcagattctgtacgtcctgggcatactgcgcgaaatcgtccccgtgcgtgccgagccactccaggtccagcccgttcgagtagaacttcccggacgccgtggtgaccagcgccttcggcgtgtccgccttctccacctcgtcgagggcggcaccgaccgccgcgagccagtcggggtggaaccggttctccgagtcaccgaggtcgagaatgaagacgtcgtcctgacggtcgagcgtgggcatggcatctcctgtcgctgatgttacccgtcggtaacttcgccatctttccgcaccccgcccagccggtcaaggcgaccccggcagcggccgtctacgctcccggtgagccgctgcgtcagggaccgatggggtggcagctgtcacgccgtgcagaagcgcatcgcccataggcgtgcgggagtacaacaccgaacggcccgacctggccttgccgacgagcccggtgccgagcagtatcgcgaggtgatcgccgacggctcccggtgccagcgcgagagtccgcgccagttgtgtcgtgctcgtcggcgtcgccagagcggtgatcagccgggcccgtgaccggccgagcagagctgccagcgaggcggccggcggcgcggggtcgaagagcgtcgcgctcccgcgggcgggatggacgatcgccttgggccaggggtcgtcggcgaagacggcgacgccgggccagatggtgaccgagggcacgagcaggaggctctcgccgtcgagcgacaccgtgccgcccgagcggccggccgcctcgatcgtgccctcgcgccagcggacctgggacgagacaccggcgagcgcggcagtccacccggcacgacccaactcgccggaacggtgcacgacgtcgcgttcgcagacggcgcgcagacgtggccagtcgtcggacagcagcacgtccaggcgcgggcgaggaagtccgccaggcggtcgagcacatcgccggcgagcaggatggaacgtgccggcgacgtggcgtccggacagcgcgccaagtaccagtcgatctcttcgcggacggcgggaaggggctgagagcgaacctgtaaaagatcttgatcgatggtctgcgccactgggccgttcgctgttcaacgccgcatcggccggcgcgcaactgctcggtctggccctcggcggcgccgcggttgcggcgatcggcgcacgccacgcgctgctgatcggcgccggctgccacgcggtcgccgccgtgaccgtccgattcgggctgccggacctgaccggcgcggcgtcgaccggttcgccggtgcgggcgagcctcaccggtgccggcacactgctgagcaacggaccggtccggcggctgctgctcgcgcagtggctgccggccgcgtccatgatgggcaccgacggcctgctggtggctttcgcctccgggcgaggctttcccggtgcggctgccagtgtgctcctggccgcgtcgcccgccggcatgttcgccggcgagctggtgatgggccggctcgtccgccccgcccaccggccacgactggtcgcacctctgatgctgctgacgggtgcgccgctgctcgcgctcggcgccgtcgctttcccggcgtccgttgcgctgctcgtgctcgccggcttcggtttcgcctacggcgtgggtctgcagcaaccgtttctccaggcggtgcccgccgagtcgcgcgggcagtcgttcgcgctcctcagcaccggtgcgatgacgctgcaggggctcggccccctggtcttcggcgccgccgcccagctcaccaccccgggcttggcgatcgccgccgccgggctggcgacgatcgcctgtctccccctggtcaggccctggtccggtcgtcgcggcaacgactaacccagggccagggtgcagctgtcctgatcggcccgcagttcggtgatgccggaaccgagttggacccgccacggcaaggcgtcgccggagcgcccgatccggatctcgtcgccctcgcgagcgaccgtgaacaccgtgtccgcgccggacggcccggggacgaccaccgcgacccggtccgccggcggttcacacaggcgcagcgtgacgccgtcgcggtagtcgtagtcggggcggtcgtggcgggcgccgaccgggatcaccgcgcccgggcggaccagcagggggacgctgaagaagtcgtgggtctcgcggacccagccgggtccttcgacgatctcgccggtcaggtagtgggtccagcggcccgcgggcacgtagtagcggacgtcgccggcggcgctgaacaccggggcgaccagcaggtcaccgccgagcaggtactgccggtccaggtaggcgacggccgggtcgtcggggaacgccaggtacagcgggcgcatcaccggcaggccggtcaggtgtgcttcgcgggcggcgccgaagacgtacggcatcaatcggtgtttgaggtgggtgaaggtgcggagcacgtcgacggattcctcgtcgaagttccacgggacgcggtacgacttggagccgtgcagccggctgtgcgaggacagcaggccgaacgccacccagcgtttgaagacggccgggtcgggcaggccttcaaagccgccgatgtcgtggctccagaagccgaaaccggacgacatcagggacaggccaccgcgcaggctctccgccatcgaggcgaagttgccggtgttgtcgccgccccagtggaccgggaactgctggccgccgaccgtggcggagcgggcgaacagcaccgcctcgccctcgccgcgcgcttcccgcagcacgtcgaagaccacccggttgtacagctgcgtgtagtagttgtgcatacgttccgggtcggagccgtcgtgccaggcgatgccgtcgaccgggatccgctcgccgaagtccgacttgaacgcgtccacgcccatctcggtgagggcgcgcagtttcgcggcgtaccactgccgggcctcggggttggtgaagtcgaccagcgccatgccggcctgccagcggtcccactgccagacgtcgccgccggtggtgcgcaccaggtagccgccggccttgccctcggcgaacagcggggatcgctgggcgatgtacgggttgatccacaggcagaccctgagcccccggccggccagtcgtttcagcatgccggccgggtccgggaagatccgggtgtcccactcgaagtcgcaccagttgaactcgcgcatccagaacgtgtcgaagtggaacacgctcagcggcaggtcccggtcggccatcccgtcgacgaacctgttgaccgtctcctcgtcgtacgacgtggtgaacgaggtggtcagccacagcccgaaggaccaggccgggggcagcgcgggccgcccggtcagcgcggtgtaccggcggatcacgtcggccggcgtcggaccgttgatgatcaggtaggagaggcgctgcccggcgacgctgaactgggtgcgggtgaccatctcggaggccacctcgaaggagaccctgcccgggtggtcgacgagcaccccgtagccggcgctggtcaggtagaacgggacgttcttgtacgcctgctcgctgctggtgccgccgtcctcgttccagatgtcgatgctctgaccgttcttgaccaggggcccgaaccgttcgccgaggccgtagacgacctcccccaccccgaggtccagctgctcgtggacgaagtcgccggccggcccggagacgacgcccatccccttcccgccactgccggtgatccgccggtcgccggccaggaagtcgagtccccagtcgtcgccggtgtcgacccgggcggtcagcgtcccggaggtgaacgtcgacgcggtgaccgtgacgtcggccggctgcccgccgatggtgaactccggacccttggcgacaccgccctggaagtgttcgacggtgacccggatgacgtcgtccatcggcgcggtcagggtgaccgtgatcagcggcgcgtccagggtgtcgccccggtcgcgcacccgccgggtggcggcgtagacggtcagcgagtccggcccgggaacgctgtcctgcaggtgagcggggtgcacgacggtgaggccgtcgcgcttacgccagtagccgtcggtgaacctcatgtgtgggtgtccttttttctcaagatcacttgatggcgccggcggcgatgccgcgcgtgagggtccgctggaagatcaggaagaagaccatcgccgggatgatgccgatcagcgcggacgcgctggtggtcgtggcgtccatcatccggtcgccctgcagcacgccgagggccaccgggacggtctggttgtcgttggagatcaggaagatcagcggcaggaagaactcgttccacgtccagatgaagaagaacgtgaacagcaccgcgagggtgggccggctgaccgggacaaccacccgccacagcgcgcgccacttcccggcgccgtcgatcgccgccgcctccagcaactccctggggaactcggtgtagaccgaggtgagcaggtacgtgccgaaggcgctctggatgacggtgaagatgatgacgatggagaacaggctgtcgtagaggccgagctgcttcgacaggtagtacagcgggtagaccagcacctcctgcggcagcaggttggcgatcaggaagaagaccaggaaccagatccggccctggatccggccgatgcccagggcgtacgcgttgaacaccgacaggatcacgccgaggaccgccaccaccaggctggtgatgaagctgttccagagtttgagcccgaagtcgacccggttccagaagtcgacgatgccctggaggtagaggtggtgcggcagcgcgagcgggccgtgcgcggcgtagtcggccgggctcttcaccgcgttgaccgcgatcaccagcagcggtgcgacgacgagcaggagcaggacgagcagcagggtcaggatcaggaagcggcccgggtggcgtccgcgcagcgggacacgttccgggatgcgggtccgcggtgcgcgcgtggcggtgacggtcatcggtggttcagctccgctcggcacggttctgcaggcgcaggaagacgatcgcgaggatcacgatcaggacggtgagcacggtggagatcgccgacccgtacccgacctgggctttctcgaagaagttcttgtaggcgaagtacgacgggaccagcgtcgcgttgctggggccaccgcgggtcagcacgaagatctgcccgaagatcttgagcgaggcgatcgtggtggtgaccagtacgacgtacagctcgggccggatcatcgcgatggtgatcctccggaaccgctgccaccaggaggcgccgtccaggtcggccgcctcgtacagctcggggtcgatgcgctgcagcccggacatgaacatgacgatcgggtagccgagctggcaccagatcatcaccgccatcacgctgtacagggcgtacttcggatcgccgagccagttgcgggacagcgagcccagcccgatcgtctccaggatccggttcagcgcgccgtaaccggggtgcaggatccagccccagatgatgccggtcaccgccaccgggagcacctgcggcaggtagtagccggagcgcaggatcgacgcccagcggtcgctgaacttcttggccacgtagtcgaacagcaccgcggccagcaccaacccgaggagggtcggcaccacggccatcgccaggatcagcaggacgatgtggccgaacgaggcccagaagttggcgtcggcgaagagccgggtgtagttgccgaagccgacccagcgggggctgccgatcccggtccaccgggtgaagctgatgtagatcgtcatcaccagcgggacgacgatcaccgcggtggaggcgacgagtccgggcaggagatagacggcgtatccgcgattcttcacgaccgggaacctttctccgtcgtgggcggcccggtccgggccatccacgaccggacatcacttgccgaggtcggccaggttctcgtggtacggcttggcgacctcgtcgaggaacgccttcggggtcttggagccgttgatcagcccctgcacgccggcgaccatgacgtcgtagtagccgggggccggccagtccgggtagaacgccagagcgtccgaggtggtgagcctggtgaagttctcgatcagctccttgttcctcggatcggtgatcgccgccgggtcggccgccaccggcacgccgccgctgttgcccagcaggttctggatctcgggcgacatggtgatgtcgatgaagtcgtacgccaggctcttggccctgctcttcgccgggacgacccacaggttgccgctggagccggggtgcagcgtgttgccggggaacaggaaggtgccccagtcgaagttcttcacctctttggcgaaccggccgtaccaccaggagccgctgatcaggatcgggaacctgccctgctcccaggagacgcccatgtcctcggccttgatcccggccgcgtccttggcgaggtagcccttggacacccagtcggcgaaggtctgcgcgccgtagctgagcaccggcccgttgaagtccaccttgttcttgtacagctggtagtcgtcgacgaaggcccggtcggccttggcgagcgcgagctcgtagaagatctgctgggccgggtactcggcgccgccgaccgcgagcggggtgaccctgttcttgacgaaggtgtccatcgccgcggtgaactggtccagggtggtgggcaccgcgatcttgaatttgtcgaacagtgccttgttgtaatagaccatgacgtactcgccgtagttgggcacgccgaagaacttgccgctgcccatgatgccctggtcggtgtacttggcggtggtctgcaggctggcgctgagctttttgtcccagccgcgcctggtcgcctcgtcggtcaggtcggtcagcaggccctgcttggcgagcaggccggcggtggcgttgcccttgttgtactccaggatgtccggcgcgctgtccgagttgaggatcatctgggcgttctgctggatctgctcgaagctcttctcctcgaacttcacctcgacgcccgggtgcttctgtttgaagatctcgatcgccctgttccaggcgatgcccatcgcgctggtcgggccttcgtagtgccagagggtgagggtcttggcgtcggcaccgtcgtcggacgaaccaccgccgccacaggcggccagggcgacggaagtggtcgtcgcgagggcgccggtgagcagcccacgtcgggtgagtgtcatgagtgtcctcccagggggaagctgaaagggaactgtcgaagcgcttcgacccgctcgtcgcattgtcgaagcgcttcgacaatggccttgccgcagacgctagggaaccggggacgcagatgtcaacggtgtgacggcgggatttcgcggcagctgtcccgctcggccaggctcggctcgagcagtcgggtgaactcgacccggcggttgtccagcaaccgcatcgcggtctccaccgcgatggtcccgacgtcgtgcgccgggatgtcgatcgacgtcagggcgaccggcatcgcgaccgccacgtcccgcgggcagagcgcgacgatcgagatgtcctgcggcacccgccggccggccgcgtgcagcaggtcgagcagcggccgcagcgcctcctcgttgtgcaccaccagggcggtgagcccgggcaactcggtgtcgaggtcggccagcgcggcccggacgccgtcggcgccgggctcgcacgggtggctcacggtccgcagccccagttccgcggaggcgcgcaggaaaccggtcaggaagcgatcggcgtacgtcgtctgccgctggtacaccgcgggcgacggaccgatcagcccgatccgccgatgcccgtgcccggccaggtgccgcagggcgagggcggcggccgcctcgaaatccaggtcgacgcaggcgatcccggcgtggtcggccggcagtccgatcagcaccgacggctgcttgagccgccggatggcgggcagccgcaggtcgtcgcgctcgatgtccatcaggatcagcgcgtccaccatcgtgctgtgcgccacccgctccagcccggcggtcccctcgtccttggtcagcagcagcacgtcgtggttgaacgaccgggccgcggtcaccacggccgtcgcgaactgcatgatgaccggcacgttcacgtccagccgcagcggtgccaccagggccagcacgttggtcttgctgctggccagcgcccgggcgccggcgtgcgggtggaagccgagctcggcgatggcggcctggacccgggcccgggtctcggcggagatcggacggcggccgctcaacacgtacgacaccgtgctgggcgacacgccggccgcccgtgcgacgtcgttgatcgtcggcaccgcgcctcccccggacatcccgctccctgcccaaccccgctcctcgcgatcctagtcaccaccccgtccacggccggtccccacggtgccgccaccggccgtggggcgaatcgcggcggggagcccgctcccatccggctccccgccgcgagtctcatcggatatcgaacgacgcgatccgcagcccgggaccgggcagcaggtacacgtcctgccggccggacgccgcggcgagcggcgcggtgacgtcggtgtacgcgtagacgccaccggtgtcgcgcaccgtcgccgtgccgagcaggcgcccgcccggcgacccgagccggacctggaccgtcccggcaccggccgcgcggaccgtcaccgtccggccgccatgcagcgcggcgtcccggaaggcgatccagtcgccggccgtgaccccgccgaccaccgtgccggcggccctggtctcatccagcagccgcaccccggcgtagtcgtcgaaggtctccgcccgggtcacccgggacagatcgcgcggcgggatcgtctcgccccggaccgagacgctgccccgctgccggatgtccgcggacgacgagccgaccagcacgtcgtacaccgagctctcggtcacccaccgttgccgggtgacgtcccaccgggccaggtcccgcggcgtcagcgggaagctcaccactctggtctgcccgggttgcagcgtcaccttccggaagccgcgcaactgctcgaccgcggtgacgtcccgggacgtccgctggtgcgtgtagagctggaccacctcgctgccggcgcgtttgccggtgttggtcaccgcgacggtgacccggccgccgccggccttcagcccgctgtaccggaaggaggtgtacgacagcccgtggccgaacggatagagcggctcggccgagctgtactgatacgtctgaccggtcttgacgatgtcgtaccggttcaggtcggccggcagctggtccaccccgcggtaccaggtctgggtcagcctcccgcccgggttcacgtcgccgtagagcacgtcagccagggcgtgcccggtctccgcgccggcgtgcgtggtccagacgatccccggtacgtgcgcctgcgcccaggtgatcgcctccgggtagctgctctgcaccaccacgacggtgcgcgggttggccgcccggaccgcctcgatcagcgcctcctgccgggcgccgagccccagcccggtccggtcgtgcgcctcccgcccggcgacgaacgggttcgtcccgaccaccaccacggcggtccgcgcccggcgggccgcggtggccgccgcggccaccccgtcggcgatgacctccctggcgaagtgggctgccgaggcggccgggccgagcccgagccggccgtccgcgccgatcgtcacgtacgtgttcgggccgaaccagctctcctgtgtctcgtacccggcgtagtgcagcaccaccgtgccgtccgtctggtcctccaccttgaactgttgctgcacgaaccagccggtcggctcggactccttcgtcacgaacggcccccagttgtagccgagcagcttgccggtgccgacgttgcgcagcgtcgacaccccgtcgccccagtccaccgcgtcgaactgggcggcgctgcccgccgtggcggcggtcgcggcgaccgcggacgggtcggcggcgctcacgtaccgcccggtcgccacgtccttcagcgcgatccggtcggcgcccggcgcataggtggccggcgacttcgcgctgatcccgtcgagcggggtgacccgatacgggagctgaccgccgtaccagtcggtgtagacggtgtcgcccagcggcccggagactgcgaccgatccgccggccgccagcggcagcacgccggtgttcttcaacagcaccatcgacgaggccgcggcctcgcgggccagctgccggtgtgccgggctgtccacgtcggacgcgggtatcccggcgtacgggccgccgtcggggtcgaactcgccgagccggaagcggatgctcagggcgtcgccgaccgcggtgtccacctggcgcacgctcagcagtccctggtcgatcgcctgcctcagcgcggtcacggtcggagcgccgtcggtgtcgtcgaccgtgaagctgtccccgcccgccttgacgatcgcggcgtccgcctcggcctgggtcgcgaagtagccctgcgaaccggtcagattggtcggcgccccggcgtccgtgacgttgaacagccgccggtcactccagccgcgcaccaggccgccgaggtcggggtcgacggtcgccggccgtccgttgaccaggttgtaggacgacatcacgccggtcgcggcgtcggcgcgcagcgggatctcgaaggtcttgcggtcgtactcgttgagcacccgctgcggcacgttcgacgaggtccggtcccgcccggtctcgttgttgtaggccgcgtagtgcttgagcgtcggcgcggtcagcagatggtccgggtcatcgccctgcaggcccctgccgtacgcggtggccaccgtcccggacagcagcgggtcctccgagtagccctcctcgttgcgcccccagcgcgggtcgcgcagcaggttgaccaccggcgcccacaggttgaggccccacaccgtcggattctgcgcgtgcagcccgcgggcctcgtcgccgaccgcggcgccgacctgccggaccagcgccgggtcccagctgctggccaggccgaccgcctgcgggaagacggtggccgtcgcgtcggtcttggcgccgccgttggtgtagtcggtggaccaggccacgccgtgcagcgcctcggtgccggacttgaagacggcgatgccgagccgcgggatggccggctggtactggtgcagcagggacagcttctcgtcgagggtgagccggccgaccaggtcgtcgacgcgggccggcagcgccagggtggggtcccggaacgggtagctctcggccgcgggcgcgggcgcggccgtcaagggcagggtgagcagggcggcggccagggcggcgaggccgcgtctcttccgcatggcgatctccctcgaagcaggcgaggacgaggacgggcgtcggatcgcttcgacatcgtgggcggaccaccgcatcgaagcgcttcgacgcatgggggtcaccatagaaggagcccgatgcgagaggcaacacccgccggaaatccggccgaaaccggggcgcgcatcccggcacaatgggcgagtgcgattaatcgtgatcggcggggacgcggcgggcatgtcggcggcgtcccaggcacgccgcaggcggggcccggacgagctggccatcgtcgccttcgagaggggtcgcttcgtctcctactcggcgtgcggcatcccgtactggatcggcggcgcggtcgacggccccgaggcgctggtcgcccgcaccccggcggagttcgccaaggccggcatcgaggtgcgcacccgccacgaggtgaccgacatcgatctgaaggcgcggagggtcaccgtccgcgatctcgacgccgggcagagccggaccgagccgttcgacgacctggtctacgccaccggcgccaccccggtccgcccaccctgggcgcggaccggggcgcgcggcgtcttcggggtgcagaccctggaggacggcgccgcactcgacgccttcctggcggcggagcggccggccaccgcggtcgtcgtcggcggcggctacatcggcgtcgagatggccgaggcgatgatcaaccggggcctgcgggtcaccctgatcgagcggtccgcgcagccgatgggcaccctcgacgaggacatgggcgcactggtcgccgccgcggtccgcaacctcggcatcgacctgcgcaccggggtcaccgtcgaggccctggagtcggcacacggcaaggtcaccgcggtggtcaccgacgccgggacggtcccggccggcgtcgtggtcgtcggcttgggcgtacgaccggccgtggcgctcgccgaggccgccggcctgccgtgcggtgactccggcggcctgcgcaccgacctggggcagcgggtcggcgagcgggtctgggcggccggcgactgcaccgaggtgctgcaccgggtcagcggccggcggatgcacgttccgctcggcacccacgccaacaagcagggccgggtcgccggcatcaacatcggcggcggccacgccacgttccccggcgtgatcggcaccgcggtcaccaaggtctgcgatctggaggtggcccgcaccggcctcagcgcggccgaggcggagcaggccggcttcggcacggtcagcgccgtggtggagtcgacgagccgggccggctacttcccgggcgccgccccgatgaccgtcaaactgatcgccgagcggggcaccggccgcctgctgggcgcccagatcgtcggccgggcggaggcggccaaacggatcgacgcctgcgcggtggcggtgtggaatgagatgacggtgggtgacatgaccgggctggatctgggttacgccccgccctacgccccggtctgggatccgattctgatcgccgcccgcaaagccggggacgccctctgacagcggcgtccccggtccttgagcggccctacccggtgacggtcccgatctcgacggcgccgcggccgacgaccgcgccctcgtcggtctggaaggtgacctcaccgaacaggtgccggccggccggcgggaccgcggcaacggtcaccgagccggtcaccgacgcgccggcgccggccgccagcggcaccggcgcgccgggcacgtccacgctgcccagcgccgggctgaagtaggcatcccggtagtcgtacgcggtcgacccgctgggcaccgagtagccctgcacctccaccttgtacgtgccggccgccggcgcgttcaccgtgaccgcctcctccgagtcgccgtccgccgacttgccgacctgcaccccgttctggtcgtagacgaacaggtccaggtcggcggccgggtcggccgggctgccgatcaccacggtcagccggctcacgccggccggcaccaccaccgggtagtcctgcacgccgccctgctcgatggtcggccgctggctcagcgcgctgcccagcgggccaccctgcgggacgaccgcgatcggcccgaaccggttggtgaccgtccaggtggccggggtggccgtgccgacctgcaccgacggcagcgacacggtggccggttcgacggtgacaccctgcaccttggcggtcagcgtgaacggattgctcagcaccggcgacgtccgccgggactcgaccgcgagctcccagacgccgggcagcgggttgtcgtacgaccgctcctcgggtttgcacgtcgccgggtcggagtagttggtgtagcagttcgggctggagttggactccaccggcacgccgtaggggttgatcgcggtccaccgggtctgcgagccggcggtcaggcccgcgaggtccacctgcagcgtggtggcgttcgccggcacggtgacgaagaacgaggtggtcgagttccggtccaccgcgcccgagaacgtgctggcgtaggccggctgcaccgcgtccagcccggcgaccacggtgttgagcacctcgaagtcgacgcccggggtgacggggtcgtccaccctgagcagcgcgctggtcacgcccctgccggcggtgacccggaccggcaccttgacggtcttgttcagcggcagcccgatcaccggcaccgtggcgaacgcgtgccggtcaccctggaacgacagggtgtgcagcagggtccggtccggtccgctggtccgggtcagcgacagggtgaccaccctggtctgccccggccggaagccgccggccgacgccgcgcaccggttgtagatgccggtgccgaccccgggcggggtcagatactgcgccagcggggtgcagaccgccgccgaggaggtgtagccgcgcacctcggcgatccgggtcagcagcttccacgacgccggcacatccagctggccggtgccctgctcgtacgtctgctcgccgcggatcgggtcggcggtggagtagatcgcgcgccgcagctgggccggggtcaccgtccgcttggtctgcttggccgccgagagcagcagcgcggccgcgccggtggcctgcggggcggccatcgaggtgccgttctccatggcgtaaccgaccggcagggtgtagccgacggtggtcagaccggccaccggctcccaggtgggggtggccgagatggccgagccgggcgcggtgatgttcggcttgaagccgccgtcctcgcgcgggccgcgcgaggagaacgggaacagctgccgcgccttgcgggtctccgagccgtagttggccagccaggtctgcttgctgatgctggccgccacgctcaccgcgtcggtggccaccgacgggtcgccgatggtgttcacgcccgggccggagttgccggccgagatgaacagctggacgccgtacttggtgatcagctgctggtagagctgcgcctgcgcgctggagccgtcgttgagcgcgggcaggccgccgatcgacaggttcaccacgtcgacgtgccggttgaccaccaggtcgaccatgccggtggtcagcgcggccgcggtgcagccgccgccccaggagcaggcccgggcggagacgatcttcgcgccgggcgcctggccgtcgaagttccggttgccgaacaggtcgttgccggccgcgatgccggccacgtgggtggcgtgcagaccctccgggatgccgatgttgacgaagtcggcgacctggccgggcagacccgccggggtgaggtcgacgtcctcgcggtactccacgacgaacggcatccgctcggcgaccggggtggccgggttgtccacgccgaagtagccgacgtcctgcttctcggcgtacggccgcatcacggcgtcgtcggtgaagtcgttgttctggttcacgtcgacccggatgtcgtggctcaccgggtcgtagaggatgccccagacgtcggtggtgtcgccgtcgcggttgacgtcaccggccggctcggaggccgcggtgatcgactcggcgaaccggttgatcaggtagttgccggccggtgcggtccaggtcgcgccggcataggtgaagctcggcccggccaccggggtgcgcatggcccgccaggtggcgtcgctctcgaccagcgggtcggtggcggtcacccagtcgacgatcttccgctcgccggtggtggtcttctgcagggccgggtgggccaggtcgacaccgctgtccatgatgccgatcgtcacgccgcgcccgtcccaggtgggatgccggcgcttgaagtcgaccgagccggtctcaccggtcggcaggtacgggttgtccgccggggtgtccgcgcccgggccggccggaagcggggcctgcttgccggcgccgcggtcggcggccacgtccggctccggcaccttgaccgtctcgtccaggtccaggccggtgacgccgggcagcttcgcggcgctgagcaccttgccggtcggcaccgaggccagcacgtagccgacctggtcgaagcggcgggccacggtgccacccagagccttcagccggccggccacgtcggcggaccggccctggccggtggcgatgatgacggtgacgctcggcttgtgctcggcctgggccgcggcgagcagcccggcgtcgtgcgcaccgagcgtgccggtcggcgactccttgggcgccacggttccggtgtccggcgcggtgtccggtgcggtgtccggcgccggtgcggccggcgcggcggtggccggcagcgaaccgttcaccgtcgtcacgccggccgccaggccgatcgccaggacggaggttaaccagcgggatggttgtctcacgtgcgggtcctccggaggattggcgcccgaaggggtgacagggcgcttctcccgggatcctccgatcgatccgcatggaagtcactaggctcaatacgcttcgtaatcttcccgtgaccattgtggaccggacacgcccgcggagatcggtttccgctccaccgggtccggccccgtccacacgcggacggtcagtccccctcggtgaggcgggccagcaccaccggctcggggcggcccgcccacatgccggtcaggaccgcgtcgcccggcaacggggcggcccacggcgtacggaacagttcgatgccgcccccggtcgtctcgatccggaccacctccccctcggcgaccttcaccggatcgccgggcgccggcgcggcggagccggcgccgcgcagcagcaggcccggctcccgcaccacgacccgctcgccgtcgtgcacctcctcggccgcctgcgtgccacccgagcggatcacctcgcccagcacgctgacgaagaccggatcgtgacaggcgtcgtacacccagcgggtcccgagcacgctgtgctcggtcgtgccgatcgcctcggccccggccagcggcgcaccccggtaggtcagcggcacgtgcagcaccggcccgtcacccacccggacgagcatcacctccagccccacctcgccggccggatcgtcgaaccgggccgcggccacccgggtgacctcgggattcgccggaccggaaaaccacggccgggtcggcagccagccgctgagcagttcgagtttcgtcgggcggatctccgccttgtgcagcaacgccatactggtcaccctaatgacgaaccgcacagtgaaccgccccggtaaacaaccgtccggccggctgcgtcttaactcagacgacgcacagacccgggggcaggcatgagaatgagcatggtggcacgcgtggcagccgcgggggcgctgctgacgatcctcgccgggtgcagcggctccggtgacaagagcgccacccccaccttcgtcagcccctccgcggccggcggcacgtcaccggcgaccgagtcgacgacccaggagtcggcggcgcgccaggcgttgccggccgcgctgcggcaccgcgtcccgaccttcaccgagcaggcaccggcccccaccaaggtcaccctgccgcccggcccgaaggcgccgaacttcgcccggatccccaccaccgagaagatcgcgttcatcacgatcgacgacggctgggagaagaatccggaagcactcaagctgttccaggccgcgaacgtgccggtcaccctgttcctcgaggtcaacgcgatcaaggacaacccgacgttcttcaccccgctgcagggcgccggcgccacgatccaagaccacacgatcacccacccgaacatgacgcacctgtcgtacgacgcgcagaaacacgagatctgcgccggcgccgacgagctgaagaagcagtacggcaaacgccccacgctgttccgcccgccgttcggctcctacaacgacaacacgctgcgcgccgtccacgactgcggcctgaaagcgtcgttcacctggatggagaccaccgacaagggcatcatccggttccagcgcccgacgcacctgatcgccccgggcgacatcatcctgatgcacttccggccggccttcatcgacgacttcctcgccgtcctcaacatcatccacaagtccggactcaccccggcccggctggaggactacatcccctgatcgccgcttgagtctccagcggggggagacgtgaggatatcggcatgaacggcgacatgctcctctcgatcggcgacctggcgcgccggaccgggctcaccgtcaagaccgtcaggttctactccgatctcggcgtcgtcgctccggccacccgcagcccggccggctaccggcgatacgcggcggacgccgtcgcccgtctcgacctggtgcgcaccctgcgcgagctcggcatcgacctggccaccatccggacggtggtggaccggcagagcaccctccccgaggtggccgcggcgcacgccgacgcgctgcaggcgcagatccgggtgctgcggatccgccgcgcggtgctgacggtggcggcccggcgcggcgccggccccgcccagctcgaggtgatccaccagctggccaggctgtccgccggcgaacgccgggaactgatcgacgacttcctcggcgccgtcttcgccgggctgcacgagcaccccgcccttcccgcggtcgcccgctcgatgacgcccgacctgccggccgacccggagccggaacagatcgaggcgtgggtggaactggccggcctgttccaggacgacgacttccgggccaccctgcacggcatggcccgcgagatggccggcgaccgggccgcggacgaccgcaccggcctgccccgggtcctcgccgacgcgatccgggcccaggtcgccccggcgctgcgggccggcatcgaccccggctcccccaccgccgagccgaccatcgcggcgctcgtcgggcactacgcgcacatcaccgggcaccccgacgacgccgcgctgcgccggcggttcgagacgctgctgaggggcatgaacgacccgcgccgagaccggtatctgtcgctgctcgccgtggtcaacggccggcccgtgccggacagcctggcgccgatgctcgactgggcggtcgcggccctgcgtgcaaggaccgcgcggtagtgggcgcggacgcggcccccgccgcctaccgggcgctgctggaccgacccggcttccggcggtacgcgatcatcggcctggcgtcgaaactggcacccggcatggccggtctgagtctgctgctcctgatcggcgaccactattcgttggcgaccgccggactggcggtcagtgcctcggccgtcgggcagggggtcagcgcgccggtgcgcggccggctcatcgaccggttcgccgccggtccggtcctgatcggttgcctcgccgcacaggtggcggccaccgtcgcgctggtcgccacggccggccggaccgggcccgccgtggtgatgctgacctgtgccgcgatcatgggagcgaccggtccgccggtggcggtcatgatgcgcacactctggcgtcgggtgaccgacgccgggacgttgtccaccgcgatggcgctggactcgtcgatggcgggcgccgccctgatcgtcggaccggcggtcgccggctggctcagcgtcgccgtgtcccccgtcgccccgttcgtggtgatcacggcgctgaccgccgggacggtcgtcctgttgatcggcgtcaccgcgacaccgtcgcgaaccgggtcgccccggcaccggccgggacgggtcgctgcgccgccctcgcgccagccggatcggctcggcacgacgctcccgagccgaccgggtccggtcgctgcggcgctcccgcgccgaccaggtctgctcgctgccgcgctcccgcgccggccgggtctgctcgccacgccgtcgctgcgccggctgctggtcgcgaacggactcttcgtcagcgcggtgaccgccaccgacgtggtgctgcccggctacgcacgggaatttcacgccgccggactggccggggtgtacctgggcgtgctctccgtcggcagcgtgctgggcagcttcgccgtgggcgccgcaccggccctgctgcgccgcggcagcgggctgcgccaacggctcggcctgttcaccgccggatccgccgctctggcgctcggctcgtggctgtcccccgcggcggtcctcctgttctgcccactcaccggcctgatgatcggcaccctcttcgccaccctgcgcaccaccggcggcgacctggccccacccgaccgtgtcaccgaaacgatgtcctggctcagcaccatggacctgaccggcgccgcggccggcgccgccgtcttcgcccacatcgccggctcagcgggaagccgcacggcgctggccctcataccggtcgtcctgctcgccgccaccgcgatcagccgcaacacccccgaaggagcgccgactccccactgagcgcgccgttcagccttccgctccaccccaccgtcgctgcagagggtttgctacgtcatcaagggtgactacggtgcgtgccgaccatcgcgctgggcagccggcacgacacccagcgcgggtcctctgcagatcagtgcgccggcagcggcccgccgccgaggaccgctggacgtggctggtcatagccgcgcatactcagccgcgtctcgccggcccttcgcaaatgacctacgccggcgacttggcatcgccagttccccattagaagtggccgaagcgaagaaggggaaggtgctgcgggcgcgccttggtaccgtcctggacgatcatctgggtctggatccggggagtgcgtccgtgttcggtgtatgtgcgtctcggcgggcggcgcggtgacagtcgcagaggaacggctcagcgcgcaaggtccggtgtccccctgggcccggtggtggtcgcggatgtcgccccgcatgcggacagtcgccctgttcgtgtccgtcggtgtgttcgtcgcgctcgccgggtggtcggtgattgcggcgttgacacggccggcgtatgaccggcttgccgatctgcacgtctatctgggcgcggtgcgcgcgatgcgggacgggatcccgctgtattcgtatgcggcggagaacggcgacccgttcacgtatccaccgtttgcggcgctggtgttctggccgctgggcgcggtgccggaaccgatggtgcaggtcgcctggacgctggtgacggtggccggggtgatggccctggcggcggccctgacggtccgcaacggcatcgccggccggcagagattcctggtggtgatgctcgcggcggccacgatgctgctggcgtcggcgccggtgcagagcaatctgcggttcgggcaggtgagcatcttcgtggtgctgctggccctggtggatgcactcggattgctgccccgccgggcaggtggcgtgctcatcggcgtggcggcggcgatcaagctgacccccctgctgttcgtgccgtatctgtgggtggtcggccggcgccgggacgcgatccgatccggggtggccttcgcggcgtgcgcggcggcggccttcgcggtgtggccggccgtctcggggacgttctggacccaggcggtgttcaccacgtcgcggatcggcgacctgtcgtcgaccgggaaccagtcgctgaacgggacgctgctgcgctacgcgattcccaccagcgagcgcatggtcgcctggacggcgttggccggactggtgtgtctggtcgcgttcctgtgcgctcgggagtaccaccggcggggacaggtagccctggccgcagtggtgatcgggtgcgcgacggtggcggtgtcgccggtgtcgtggactcaccaccagatctggaccgtgctggccgggatcctgctgatcgccgggccgcaccgtggccggatcgcggccggcgtggtcgtgttggtcacgatgtccgtgcaggtcggggcggtgctgccggtcggcgggttcctgcacgacaacgcgcgggcgtggtgcgcggtggcggtgtgctgcggcggggcggtcagcctgtggccggcggcggccgggcgggtacggctgctgccgggtctcgcggtggtaggccgaccgcgcacggcgttgctgtactgcacggcggccgccgcgggaatcgccggagtcttggcggtcacgcatgatcgagcggtcaccgcgcaggtgtacgcggcggcgaacgcgcaggatccggtctggtcacaggtgttcagcagcggcccgtgcggaggcatgggactgcgggacggcagatacgtctgctcggacctgaccgggccggcgatggccggtgagcagctgaacttcgcggctggtgacgacggtgccggccacatcgggatcgagggacaggcgggcccggacgtggtccgtttggtgtatgtcccggtacagggcgccaagccggtcgacgtgccgctgtggccggaactgcccgcccccaagaccgcgccggactcggacgacccacccaagctgcttccggtcgtggacgagcgcagcatgacgacgcaccgcttcggggtgcgcacgaacgaccccactgacgcggtcctgctggcctacgaccgaaacggtcaggtcatcggcaccgggggcgacaaactgcacgacatgtcgtaggcggctgccggccgcgccgtggtcagccgggacagtgatcgacccggggcgtaccggtcaggctgaaccgcaggtcagcaaggtcgccttccgccgccggcggttctccggaaaaggggcccctcttcaggagccccttcctcggcgttcgcggacggcgacctacagacccatgtccttcgcgatgatcatcttcatcacctcggaggtgccgccgtagatccggttcacccggttgtcggcatagagccgcgcgatcggatactcgttgatgaacccgtatccgccgtgcaactgcaggcaccggtcgatcacccgatgcgccacctcggtgcagaacagtttcgccgaggccgcttcggccgccgtcagttccccggcgtcgagggcctccagcgcccgatcggccacggcctgagccgcgtccacctcggcctgacaggcggccagttcgaacttggtgttctggaacgacgacaccgtctggccgaacaccttgcgttcctgcgtgtacttcttggcgaattcgaccgcggccgccgcctgcgcgtacgcgccgtaggcgatgccgagccgctcctgcggcaggttctgccccaggtacgagaagcccttgttctcctcgcccagcagatcctcgaccggcacgaggacgtcctggaacgccaattccgcggtgtcggacgtcttcaggcccagcttgtcgagtttgcggccgaccgagtagccgggcagtttcgtgtcgacaacgagcagcgagatgccgaagcggcggtcgtcgggtttcggcggggaggtgcgggcgcagacgatgacgcggtcggcgagaacaccgccggtgatgaaggttttcgcgccgttcaggacgtagtgtctgccgtcctcggtgagtttcgcggtggtggacatgccggccaggtcggagccggtgccgggctcggtcatcgcgatcgcgaacatcatgtcgccgctgacgaaggacggcagccaccgctgcttctgctcgggggtggccaggttcagcagatacggcaggcagagagcgacgtgcacgccggagccgccgaacgagacgccggcccgggcggtctcctcgtactgcaccgcggcgaatttgaacgagtcgatgccggcgccgccgaactcctcgggcacctcgatgccgaacagaccgagttcggcgagcttcttgtagaactcgcggggcacctcgccgttgtgcagccactcgtcgtaattcggcaccacctcggcctgcaggaattcccgcagcgtctgccggaaggcctcgtggtcctcgttgaaaatcgtgcgacgcatcgaagaatccctcagtgtttagagacggcgtccgccgtcgacgtaaatggtctgtccggtgacgaaggaggcggcgtcactggccaggaaggcgaccacccgggcgatgtcctccggctgcccgacccggcgcagcggcgtgatctcggctgccttggcttgcatatcggcagccgagacgccgatccgagcggcggtggcgtccgtcatctcggtgacgatgaagccgggcgcgaccgcgttgacgttgatcccgaacgggccgagctccatcgccagggtgcgggtgaagccctggatgccggccttggccgcggcgtagttggcctggccccggttgcccagcgcggacacgctggacgtgttgacgatcttgccggtgcgctgcgggaccatgtgccgctgggcggcccggctgcacaggaacgcgccgcgcaggtgcacgttcatcaccatgtcccagtcggacgcgggcatcttgtgcagcaggttgtcccgggtcacgccggcgttgttgaccagcacgtgcaccccgccgagctcggcggcgaccttgtcgatcacggcgtcgacctgggcctcgtcggccacatcgcagccgtgggcgaccgcggtgccgcccgccgctctgatccggccgacgacgtcggcgcagtcgtcctcgtcgaggtcgagcacggcgacggccgcgccctcggtcgcgaattgcagtgcggtggccgcgccgatgccgcgcgcggccccggtgacgatggctacccggctcattcagaaactcctttggggtgaggaagcactgcctagaacgcgctgattccggtcagcgcccggccgatgagcagcttctggatctgactggtgccctcgtagagggtctgcacccgggcatcgcgcatgaacttgccgaccgggaactcgtcgatgtatccatatccgccgaacacctggatcgcctgattggcggccttgaccgcggcctcgctggcgaacagtttggccatcgacgcggcggtgccgaacggctggcgccggtcgaccaggtcggcggcgcgccagacgagcagccgggccgcctcggtctccaccgcgatgtccgcgagcatctcctggacgagttggtacgacgcgatcggcttggcgaactgggtgcgctccccggcgtaggccaccgcggcctccagacaggcccgggacagcccgacgcagccggaggcgaccgcgatccgtcccttgtccagcgccgacatcgcgatcttgaagcccgcaccgaggtcgccgaggcgctccgcgtcggcgacccggacctgctcgaagctgagctcggcggtggcctgcccgcgcagccccagcttgcccttgatctcccggcgggtgaggcccgcgcggtcggtcggcaccaggaacgccgagacgcccttcgggccgggaccgccggtgcgggcgaagaccagggccaccccggcccacgtaccgttggtgatgaagatcttctcgccgctgatcagccagtcgtcgccgtcgcgaaccgcccgggtgaccaggttgccggcgtcggacccggtgcccggctcggtcagcgcgaagcagcccagcgtctcgccggagcagaaccggggcagccagtgcgcccgctgctcgtccgtcccgtacgcctgaatggtcttggcgaccaggccgagggtgaccgagacgatgccgcgcaccgcggtgtcaccccggcccaactcctccatcacgatcgcgtagtcgaggaagtcaccgcccgacccgccgtgcgcctcactgattcccaggccgagaaagcccagctcggcgagcttgccgacgatcttcgggtcgacctgctcggcgcgatcccactcggtggcgtgcggcacgacctcgcgctccacccagtcccgggcgaggtcgcgcagctgttgctgttccgccgagagggtgaggtccacggcccgctcctaaattgaacgctgtcaggtttccccggccatgttaacttaacagcgttaggcatcacaacggtcaggagagcaacccatgccgcggccgaccaccccgctgctcagcaaggccgggatccgggccgccgcgctggagatcatcgaccaggacgggctggacgggctcagcatgcgcaagctggccaccgccctcggggtcagcgcccccgcgctctacttccactaccccaccaaggagcaactgctcgacgacgtggccagcgagatcatggagcaggtggacgtctccgggttcgccgccggctggcgcgacgggctgctcggctgggcccggtcctaccgggcggcactcgccgggcacccgaacatcgtgccgttcctggcacacggccccggccagcgcgacgcctcgctacgccgggccgacgccatccacggtggcctggtcgcggccggctggccggcccgggacgccacgatgatcggcgcctcgacgaaatatctggtggtcggcgccgcgatgggctcgttctcccgcggcttcgtcgacgacgtgcaggtctacctggaccgctatccggcactcggcgacgcgcaccggctccgcgagcacgccgacgccgtcgaccgggacagtttcgagttcgcgctcctcacctttgtggacggacttgccgcccgcctcgcccgatcggcgacaccgccggtgcattgatcaccgttttcctgcatcgtggaaacgatggggatccggcgggtgttcaaaagtcagcggctctggctcgacctggccgggctcgcgctgtccgccggcctgttcgtggcggccttccacgcccacgccccggtgcaggacatgctcgtcggggtggccacctcgttcatcttcgccaccatcctggacatgttcgtcaccctgcagaacaggctcgccgaccgcgcccgcgtgcatttcttcggcgccgagctggtccgccgggaaacgctgctctgctatcccgacttcgtcatgcacgacgacgtccgggccaccctgaacgaccacaaccagcagatgctgttccagcgtccgcactcccggttcgtcgagttgaccgtgcaccggatcgacatcccgcgggtggtcgccgccaacgacatccagtcgctgctctacgtctcgtccgctttcgaggcccgcaacacctgcccggtgatgatcacggtcgacaccgcgatcgtcgacgactgcgcgcgcagcttcgtcagtttcggcctgtccagcaacgactgcacgcacctgtacgccaacgagcacgccgacccgctgttcaccatcatcgaggacgaggtcggctccgaattcatccggctgcgcaacggttcggagtaccgctccaccaagcgcaagcagtacggcatcatcctccgctacgctccgaacccggaggagttcccggaacgtcgctggctgctggtcgccggcctcggtccggtcggcaccaccgccaccgggtggtatctgtcccagcactggcgccagctggccggcagcgtgccccgcgacaagaatttcatcgcggtcctctccaccggcgtctacaccgaccacgcaccgcatctcgaggagatctgcctggatgactgaggtcctgctggccgggctgtgcacgctcgacatcctgcaactcgtcgagaagtacccggccgacaacgagaaggtcaccgcgctcacccagaccgtcgccgccggcggcccggccaccaacgcggccgccaccgtcgcccacctcggcggtgatccggtcctgctgaccgccgtcggccgccaccccctcgccgccggtatccacgccgacctctccgccctcggtgtccgcctcatcgacctgaccgataccgatcccggcgcccccagcgtctccagcatcgtcgtcagcgccggcaccggcaaccgggccgtcgtctccaccaacggcgcggcccgctcggtcaccgtcccgcacctcgccgccctcgtcgacggcatgagagcagtgcaagtcgacggccactatccggagctggccaccgcggtcctgaccgaggcgcggcgccggggcatcccgaccctcatcgacgccggcagctggaaaccggtcaccccgcggctgctcccgctgctcgacgtggtggtctgctccgccgacttccgaccgcccgggatcagcaccccgcacgacgtcgccgccttcctcgccgacgccggcgtccgctggatcgccatcagccgcggcgaccggccgctgctccgctggaccggcggcggcttcaccgagcagccggtcccggcgacaccggtgatcgacacactcggcgccggcgacgtcctgcacggcgcgctcaccctcgcggtcgcgcgccgctggccactcaccgacgcgacattcgccgaggcgctcgacgaggcggcggcggtggccagcaggtcgtgcggctctttcggcacgcgtgcctggatgtcctgaagaatcaggatcaaattcttcatacagatgtcgtgcgctgcggccgataactgatcgccgctcccgccgcaccgggcgcggcgatttggccgctggcgcgtccagatcaatcgccgcacccttccacatccgctgtcggtaacggagaaacgcgaccggaccgaatggatcacccgcgcctgatcaccgcggggacagcacgagcagggtcagttcggagaccgccggctcgcggaccccggagtccgccgccgcccgcagcgcccgcagcccggcggcgaattcggcatccgggatggcgtgcagggtggtgttggcgcgatgccggaccttctcgtaatagtcctccagggtcgccgcgttgatctgccggacccggcgctgctcccgcagtgcgtagccggccgtctcgaaagccgcccggacctgcgccaccgtcgggaaggtgtccagcaccgctcccgccgtcgggaagaaccggtacagcgcgatccgctcctgatcgccggggaaggcactgcggatcagcaccggcgcctccggcagcagcacccggcgcagctcccgcgccgccgccggcaggtcccccacgtggtggatcatcgtggacagccaggccgcaccgcagcacccgctcgcgagggggatccgctcggctcgccccaccgcccggtgcgcgggcggcgcggcctgccgcagcatcgcgaaggccggctccacggccaccacccgcaccccgaaccaggtgtgcagcagccgcgcgtacagcccggtgccggcacccaggtccagcaccggggcggccaccggcaggtgcgcggcgagcgccgtccgccacccgtccaggccgccgtccggcgcgccgcgacccgattcgtacaccgccgcgaccgggccctcgaagtcgatccgcgccatggcagccccccgtcggagatcgaagttattgcatatcctgtcggctatgggcggcctcgtcatcctcgatctggacgacaccctgctgcgcaccgcggccgccacccgggccgcccgccggctggtggcggaccgggtcttccccggcgccgccgaccgggtgctgccgatctggcggcgggtcaccctgctctatccggaccagcagttcgatgatctcctgtcggtggtggccgcgctgctcggcacccgtttgccgcccgacctcgacctgcgggaactcgccgccggctatcaggctgccgcgctggcgcggatcaccgcccggccgcgggtggtggccgccgcacgccgcctgcgcgacgtcggcgggcatgatctggcgatcgtctcgaacggggacgacgccgtgcagcgcaccaagatcgagcggtgcggtctgggtgatctggcaccggctgagcgggtggtcatttgcgacggggtacgcattccccgcaaaccccatccgcaggcggtgcacgccgtgctgaccggcgccccggccgtgctggtcggcgaccggaccaccgacgtgctgtgcgcccggcgcgccgggatcccggtcgtccggctacgcgcccgcaccgccgacctggaacgcggcgccggcctgcgcgcgatcgcccgcccggacgccctctgttcggccgccgagctctacgaggtgacccgggaactcctggaggaacgaggatgaccacgcgcagcctgcccgaggagaccgcgttccgctggcgtcagttcaccggcctgggcaccacccgggtgcactgggactggcggggcggctggcggccgggccggtggtcgtactggtggtatctggatctgaccggcgccgcggagctcgccgcgctggccgcggacctgctggccgagctgcgcctggagtgcctggacccggccgtgcacctgcacgtcagcctgcagcaggtcggcttcaccgacgaggtcaccgccgggcaggcgcgggccctgctggccgcggccggccggctcggcctggcgccgctggagctcaccttcggtccggccgacccgaacccggagtcggtggtgctgcgggtcagcccgtgggagccgatccagcagcaccggctgcggctgcgccgggtcaccgagccgatcgtcggcacgctcaccggcgccgacgaccacttctggccgcacgtctcgatcggttacgtcaacgccgtggtgccggccgcgccgatcgccgaggcgctgcgcgcgctgcccgaccgccgggtcacgctgaccgcgcgcgaattgcggttggtccggctcaaccgggacgaccgcctctggaaatgggatgtggtcggcgcggtgccgctcagcgccgggccggcgagacgatgaccgcggcccggccggccgccgcgacgaccaggccggtgttgcgtttgtcgttgccgtcgacccaggccgcggccgcctccggggtgcgcccgccggccacctggcggtcgacgagacgctgccgggtcacctcccagggcacgtcgagataccagatctcgtcgaggcactcgccgacccggtcccagccgtcatcgggcagcagcaggtagttgccctcgctgatgatcagccggaccgaggccgggatccggtgcgcgtccggcaccggctcgtgcagctcgcggctgtacgccggggcgccgatctcgtcctgcgcgtcgcgcgcccggcacagcaggtcggcgaaaccgtcccggtcgaaggtttccggcgcgcccttgcgatcccgcaggccgcgctcggcgagtaccgcgttgctcaggtggaacccgtccatcggcacctgcgcgaccagcagcggatcggcgccgaaccgctcggtgacccgcgcctgcaaccaggcggccagggtgctcttgccggcgccgggcgggccggcgatcccgatcagcacccgtctgcccgacccgagcagtgggacgacgcgcgcgaacagctgctcccggtcccgaaccacgtcggccatgcggcaccttccagcgcgaacggacggtccctgacaggctaacccgcggacgccggtttccagcccagggccgggccgagccgctccgccatgtcggtgaggatctgcacgtagtcgtcgtgcccgaaggtgaacggcagcgcgaacgccacctcgtcgatctcccggaacgcggcgtgcgcctcgagccgctcggcgatctcggcggaggtgccgacgatgtcgggcgcgaacatcatccgggccgggccctgcggggtcgtcgtccgcggggtgcgctgctcggcgtacgcggcataccgggcgcgctgctcggcggtggccgagtcggtggggatcaccaccaggccctgcgagacccgggcgcgatcgccgtccgggtgggcggcccggaaggcgcgcacgtgcgacagctggatctcggcgaagtcctccgactcctcggccttgacgacgctgctggtcaggaagttgatcccgtgctcgccggcccaccgcgcggagcgcaggctgccgccgccgtaccacatccgggacgcgagcccgggtgagtgcggctggacccggtcggagaactgctcgaacccgatcgctccgcgcaggtcggtcgcctgctcaccgcggacgaaagccagcagtctctcgacccgggaatagctgaagtcctcggcggcggccgtgtcgggatagagcgcgtccttgacccggtcgtagttcatcggcgggccgacgctgatgcccggatggagccggcccccggagagcaggtcgacggtggccagatcctcggcgaggcgcagcgggttctcccagccgagcgggatgaccgcggtgcccaggtcgatccggctggtccgctgcgaggcggcggccaacaccgcgaccggcgacgagatgccgaactgcaggtgccggtggcgcagccaggcgctgtcgaagccgagccgctcgcccagctcgatgatctccagggtcgactcgtgaccccggcgcggatccacctcgtcgaacagcccgatggtgaggaaacccagcttgcgcagcatgtcagcaccctatcccggagatgtgaaccactcgccgttcacaagatccttcatgtttcgcgacgggtggctagtctgggtcgatgtcccgcccccggacccgtgcctacctgatcgcggcggccgccgccgcggtgctcgccgccggtgcggccgtcgctgtcgcccacgaccgcgcccccgatccggtcgccgggcagtgggtcgcgcccgccgccgcggcgctccggccctcgcccaccgcctcggcgaaaccgctgcccgccgcgaagccgccggccggcctcccggtgatcgagtacgcgtccggcccgtccgggctgcccgccgacccggagcagaactcgaccgtcgcaccgacccgggccctgcaccccaccaccaggatcgcgctgtacgacgcaccgggcggcaagccgcgcgcctacctcccgcccgacatcagcgggttgcgcaccgtcgtcccgatcgtcgagcagcgcgacggttgggtggccgtgctggtcccgtcggtcaaccggcggatcggctgggtgccggtgggctccggcgagaccgtcacgctgcgcgaccagctggtcgcccagctctccgagcacgcgttgatctggctgcgcgacggccaggagcagcagcgctggacggtggcgaccgggtcgaaggcgaccccgaccccggtcgggcgcacctacgtgatgggcacgaccccgttgaagggcgacatctacctcaacatgggcgcgctggtgctcggctcggtgccggagcagccggagaagatggccgcggtgttccagctggcgcacaccggcatccacgcctggtacaacaagtcagcattcggccacagcgtgtcgaacggctgcctgcggatgccgaaggccgcccagcagaagctgctcgacgagattccgccgggaacgaccctgacggtgctgtcctagcctgtcgcggcgcgggcgccggccgctgaccgagcaggtcgggccgcgtcgcacctggtcgtgcaccggcgcgacctcgtagcggccggccggacgcagcatctgttcccgaaccagcaccagcaggtcgggcatcggcaggttcagggcgcggcagatcgcggccagcacctccgaggaggcctccttggtgccgcgctcgacctcggacagatacggcagcgagaccccggccgcggtggcgacctccttgagcgtgcggccctgacgctggcgcacgcggcgcagcacttccccgatgacccggcgcagcagtggcatgcccgtcccctccccgatgtgtgacgtccatcctgccctactgggccgcatcgccgatcggtgctaccgtgggcccatcccggatgccggtggcattccccgcccgggtttttgtttctcctcccagcgtcatgcgcacgctggctttcctcaggcttctgcttctcacccaccgcggcttcgatgcccggctaggagtttttccatgacagatcttcgtacccggaaaccacccgtggcgaccgacgagaccgtcgccgtcgacgccatcctcgacatcaccgacgaccgtggctggctacgcgccgacggctacctgcccggcccgtccgacctgccggtcgccgtgcccgacctgcgccggctcggcctgcgccgcggcgaccgggtcaccggcttcgcccggatcagccgccccggcaaaccggtcaccctgcagctcaccgccgtcaacggccgcccgcccggcgcccgccccgacttctaccagctgaccgccctctacccgcagcagcggctgcgcctggaaaccgaccgggaggtgctcgcgacccgggtgatcgacctggtgatgccgatcggcaaaggccagcgcgccctgatcgtcgcgccgcccaaggccggcaagaccacgatcctgcaccagatcgccaacgcgatcacccgcaaccacccggaatgccacctgatggcggtgctggtcgacgaacgcccggaggaggtcaccgactggcagcgcaccaccaaggcggagatttgcgcggccaccttcgaccgtccgccacagcaccacaccgccgtcgccgagctggccgtcgaacgcgcgaaacggctggccgaactcggcgaggacgtcgtcgtcctgctcgattcgatcacccgcctgggccgcgcctataatctgaccgccccggccggccgcggacgcaccctctccggtggcctggacagcaccgccctgcagcctccgaaacgcctgctcggcgccgcccgtaacatcgaaggcggcggctccctcacgatcatcgccaccgccctggtggagaacggctccaccctcgacaccttcctcttcgaggagtacaagggcaccggcaacgctgagctgaaactggaccgcaccctcgccgaatcccgcgtcttccccgccatcgacgtggccggctccggcacccggcacgacgagctgctggtgtcccccgccgagctgaccgtcctcggccagctgcgccgggccctcaccggcgccgaccgtcgcgacaccatgcagcagctgctcacccagctcggcaccacccccaccaacaccgatctgctgcgccgcgtcgcacactccctgtcctgaccgcaccggcagcgacaaagccgcatcgcccgcctccgtcgggaccccaccggcagcggcaaagcggcgccgcccgcctcccgtcgagaccgcaccggcagcggtaaagccgcgccgcccgcctcccgtcgggaccgcaccggcagcggcaaagccgcgccgcctgctccctgcccgggtgcgccgcccgctccctgcccgggccgcgacggcagcgatctcatgaggacgaaaagcggattgccgcggctgcggtccggggaactaggctcctgtccagggaggttggatccttggcggaggaacacgacatcggcgggtcgaccgtgcgacggctgcaggtcggggcgcacctgcgcgcgttgcgcctggccggtgggctgagccgggagaaggccggatatgtcatccgcgcctccgagtccaagatcagccggatggagctgggccgggtcgggttcaaggaacgtgacatcgtcgacctgctcaagctgtacggcgtgaccgaccggagcgagcacgagcgcctggtcgcgttggcccgggaggcgagcgcgccgagctggtggcattcctacgccgacgtgctggacacctggttccagaactatctggacctggagcaggcggccgagctgatccggacgtacgaggtgcagttcgtgccggggctgctgcagaccgacgcgtacgcccgggcggtgatccgtctcggtcacggccatgccgacagcagcacggtcgagcgccgcgccagcctccggatgcaacggcagaaggtgttgcgtcggccggacgggccgcgcctgtgggcggttctcgacgaggcggtgctgcgccgcccgatcggcggccgggcggtgctgcgggagcagatcgccacgctgatcgagacctgccgctcgccgaacgtgcggctgcaggtggtgccgttcgagtcgggcgggcacgcggcggccggcggcgcgttcagcattctgcgcttcccgcacgaggagctgcccgacgtggtctacatcgagcacctgaccagcgccctctatctggaccggcgggacgaggtcgaccactacgcggccgcgatcggccgcctgttcatcgaggccgagccgcccgccgagaccccggagatcctcacccgcatcctgcgcgagctggacaccgggaagatctgagtcagaagcggatcaccgcgcggctccgggtcaccagagccacgctgcagcgggcccggtgcagcaggtgccgtcccaccgagggccgcagcgccacccgcagcgcccgccgcgcccgcgccccggccaccaccagctgcgcgcccgccgcggcctgcgccagcacctcacccggcgacccgaccaccacttcggcgctgaccggcacccgtggataccgccggcgccagcactcgaccatcgcctccagccggccccgctcgtcggcgatggcccgcaggttggtgtcgcacagcaggtcgcgcccgtccggcggggaccagccgtgcaccgcccggaccggcaccccgcgcaccaccgcctgctcgaaggcgaagccgagcaccggaccggccgcctccgagtcgtcgaccccggccaccaccgggtcggtctcccgcggctcgccgcggaccaccacgaccgggcagcgggcgtgcgcgctgaccgacccgctggtcgagcccagccaggcccgcaccccggtcggccgccggccgccgagtaccaccagggacgcctcggccgcgcgctggatcagggcgaccgccgcggtggcgtgctcgacccgggcgcgcaccgggaccccggggtgactgctcgtcgcggcgtccaccgcccgcccgagcatgtccgcgacggccaggtcggtgtcgaggtcggggtagaccgcggcggccggcatcatcgccgcggccggcacgtagctgggccactcgtacgcgtagaccagctcgaccggcacgccgccgcgttcggcctcgtccagcgcccagcgggccgctttgcgggcctcgaccgagccgtcgtagccgacgacgatcctgcgggtgtgcacggcgccgcctccttccgcgctcctgtcccgatcgtcgccgctgggccccgtccgggcaagactgtggggcccgtcacattattaactcaagatttcgatgtggacagcaccttcggcacttctccgtcgcgccgcggcagagatcggtgacgggcgggttaccgggatcactcgtccgctgtccgggatcggaaacatggatttgatctacgaccggtattttcctcgcgccgcgccagggtcgtccggcactgccatccggcgccgttttcgtctgaggagaatgccatggctgtcaaggccgagtacctgtgggtcgacggaacccagcccaccgccaagctgcggtccaagaccaggatcctggccgacggtgcggagcccccgatctggggtttcgacggttccagcaccaaccaggcgcccggtgacaagtcggactgtgtgctccgcccggtcttcacctgtccggacccgatccgcggcggcgacaacatcatcgtgctgtgcgaggtcgagctgatcgacggcaccccgcacccgaccaacacccgcgccgcctgcgtcgcgtccgccgagaagtacgccgaccaggagccgatcttcggcatcgagcaggagtacacgttcttcaaggacggccgcccgctcggcttcccggccggtggcggcttcccggccccgcagggcggttactactgcggtgtcggcgcggacgaggtgttcggccgggacatcgtcgaggcgcacatggacgcctgcctcacggccggcctgcacctgtccggcatcaacgccgaggtgatgccgggtcagtgggagttccagatcggcccggtggccgccccgcaggtggccgacgagctgtgggtggcccgctggctgctgtaccgcatcgccgaggacttcggcatctccgccaccctggacccgaagccggtcaagggtgactggaacggcgccggggcgcacaccaacttctccaccaacgcgatgcgcgacaactacgccgcgatcatcaccgcggccgagtcgctgggcaagcgccgccaggagcacgtcgacggttacggcgcgggcatcgagcaccgcctgaccggcctccacgagaccgcaccctggacggagtacagctacggcgtgtccgaccggggcgcctcggtgcgcatcccgtggcaggtggagaaggacggcaagggttacctcgaggaccgccgcccgaacgcgaacgtcgacccgtacgtggtcacccgcctgctgatcgacacctgctgcgcggcgctggcgcaggcctgatcgcccggctgggatgacgcgcgggctccggtcgtccggtgcccgcgcgtgttcctttccggtcctggaatactccccggcgtccgcgggtgtcatgatgggccgggcaggtttccccgggcagggaaaggtacggcggtcgatggcgagcttcgaggcgaggacagccgccgcgccggaccatgtcaccgtgttcctggccggtgactgtgacctggcggcccgcgaccggctgaccgccgcgctgctcgacgcggtgccccgcgccggcgaggtgttcgtcgatgtttcgggggtcggtttcctcgattcgaccggggtgcacgccctggtgaccgcccatcacgcggctcgcgggcggggtggccggctctatgtcgtcggcgccgccggctcggtcgccgcggtgctggaaatgaccggcctggacgcgcttctgaaagcgcccgggggttcgaccgccgaggacgggcgtcgccatgcctgacatcgacagcatgtcctacaccgagccggacgatctgcgcaccgtccgcgtcttcgtcgcggagcgggcccgcgcgctgggcctgccggccgcccggatcgagctgctcaccctcgcggtcagcgagctgaccacgaacacgctgcagcacaccggcggtggcggccacatccgggtgtgggccgaggacggccggctggtctgtgacgtggtggacggcggcggcccgcgcccgttcggccgcacgatgccgtcggcggaggcgatccgcggccgcggtctggccatcgtggagcgggtgtgcgacgcggtctacacgaccgccgtgccgggcggcaccatggtccggatctgtctcaatctctgaccagcacagcgagggtgcaggtgtcgtcgtcggcgctcggcgcgtacagcaatcggtgaatgtgcggcagcgggtcgggacccggcgccgcggacaccgcgctgagacggtctcgcacctcggtcgtgcgccgggtcgcgtcgccgcggcgttccaccagcccgtcggtgtagaacaggatcaggtcgcccgggcgcagctcggcgtcggcgaccgggaactcggtgtccgcctcggcgcccagcagcagcccgggcgggcgttccaggtcgacggcgcggccgccgcggcccagcatcggggccatgtgcccggcgcgtgcccagggcagccgcccggtgccggggtcgtagacgccgaccaccgccgtcccggtgatgccgagctgggcgcacagccggttcaggtgccgcagcagcagtccggggtcgcggatgccgaccgagagccagccgaccagggcgaaccgcaggtgggccatgccgctggcggcttccatgccgtgtccggcgacgtcgccgacggcgagcacgacgcggccgtccggcagggtctgcgcgcagtaccagtcgccgccgacctggaccgcgctctcggccggttggtagccgaccatcgcttcgaggtcgccgagccggaacgggccggccggcaccggctggatcatctgctgcagctgccgggccagccggtgctcggcgagcgcggtcagctcgccgacccggacctggtcgctgagccgctcgatctcggtgcgggaggcgacccgggcggtcacgtcctgcaccacggcgtagatcttcaccggccggccggccgcgtcgtgcgccaggtcggagaggatccgcaggtgtttgacgcggtcgccgatccggaaccggacggtcacgtcggaggtggccccgacgtccagggtctgccaggcggcctcggcgatcccccggtcctcggccagcatcgcggcggcctgctcgacgcgggacagcgggccgtcggccgggtcccgctcgaagatccggtacatccccggggaccactcgttgccgccggtggccagctcgtgctcggcccagccgaggctgccgagcagctcggtgctctccagccggcggcggtgctcgtcgacccgggcccaccagaccagcaggccgccgaggaccgggtacacgctgatctcgaagcgggagtcggcgaccaccccggggcgcgactgctcgaaccggaactcgtccatggtggcgggcgtgccggtggtcagcacctcgacgtagagccgccacagtggtccgtccaccatggacggatacagctcggcgagcaggccgtcgacgcgttgcgcgccccggccgtagatgtcgtggatctggtcactggtcgcggcgacccggaagtcgatgatcgcgccgtccggcccggtgaccgggaccagccaggtgcagccggccggaatcgcggcgaggagttcccggaccacgtcgtcgacggccatccccgaagcctaccggcagatcacagctttcccaccggacaccgcttggccgatatccggcgataagccgtgaaaagccctctagcaccacaacgagatgagccgcagcatcggcgaggcggccggcggcagcaccagcatcgccggcagcatcaccgcggtcgccagcgccgcgcacgcgaccacgtccgcgctcggcgaggcggacgcgtcgatgagcgagctgacccgggtcgccggcgagctgcgcgacgtggtcgcccggttccgggtctgaacgggtcagtgcccgagcagccgctgcacccgctccagcagatcggccgggtcgatcggcttgaccaggtagtcctcggcgcccaccacgcgtcccagggcgatgtcgtccggctcggcgcgcccgctgatgaagatcaccggaatgtgcgcggtctccggcgacgagtgcagctcgtagcagaagcccagcccgtcgaggcccggcatgcacacgtcgagcagcaccagtgagggccgttcgccgaccgcgagggccatcgcggtgcggccgtccgcggcgatcagggtgcggtacccggccgcccgcagcttggtgccgaccaggtcgcggatgccttcgtcgtcgtcggcgatcagcacggtcggcggctcgagagcggccgcccagtcacccatcggccaggtcaggccggcctcggcgtcgctgaacgtcaaggccgtggtcgaggtgtgcggcatgctgtcggctccttctgtgctgggacccgtgagatcgtccagccggcccgtcgcggcaggaaaccggtgggtgccatcgggttgcgaacgcccccacagattaggttagggttacctaaaccgatccgggaggcgaccttgaccccgaccgctgcgccatcgaccgaagcactcccgttccgcttcttcccggtcgaggtccgccgggtcacccgcctgagccccagcttcctgcgcgtcacgttcaccggcgacgacctcgaccggttcgccgccaacggcctcgaccagcgctgcaagctgatccccccgctgcccggcagcggcctcgaccacctgcccaccggcgacgactggttcgccgcctggcgcaccctgcccgacgagcatcgcaacccgatccggacgtacacggtgcgcgccgtccgccccctcctcgccgaggtcgacatcgacatggtcctgcacggcgagaccggtcccgcctcccgctgggcggtcaccgccgcccccggctcgatcgcctgcctgctcggcccgaacgcggacttccccggcgtgcacggcggcatcgacttccacccgccggtcggcaccagccgcgtcctgctcgccggcgacgagacggccgtccccgcgatcgccgccattctcgccgcgctccccgccaccacctgcggcgacgccgtcctcgaggtaccggtcaccggcgacgagctgccgctcaccgcgccggagggcgtgcggatcacctggctcccgcgggacggcgccgcccacggcgcgaagctcgtcccggccgttcaagcggtgatcggcgtcaatggcgtcaccggcgccgagctggaggacgtcgacgtcgacgcggacatgctctgggaggtgccggacggctccgccgccaccgacggcttctacgcctggctcgccggcgaggccgccgtcatcaggacgttgcgccgccatctggtcacgacctgcggcgtcgatcgccgggcggtggccttcatgggctactggcgtctcggccgggcagaatgctgaccacgaaccggtgccgtcgggtccaaaatagagatgacagtcgccaccgggctccctagggtgccgatcatgactgccgaatcccgggacctcatctggcgcccgctggccgtgtccgacgccgcggcgatggccgacctcttcaacgcgatcgacgacgaggatcacgtctgggggcagtacaccgagcaggacgcggccgaggaactggactcaccggtcgacgacctcccgacgtccacgctggcggtgttcgacggcgcgacgatgctcggcttctccgcggtccactacaaaccggcagcccaggtcgtccaccgggtacacgcggccggcgccgtccgacccacccatcgccgtcagggcctcgggacgaggctcatgcagcacggactggcgaccgccaaggcgctgcacgcacggcatcaccccacgctccagctggtcgtcgaatccgtctacggcgagcacgtgcacggggccgtcgccctgtaccgcgcggcgggcatgacgtcgacgaagtggagccggcacatgaggcatccgctcggcaccgccattccggacgcccccatccccgacggtctgcacatcgagagctacacggcggagaccgacgaggagttccgcacggtccgcaacgacgccgctcaggccttgggccggtcgccgctcagcgccgaggagtggaaggtctgggccgtgaacgcgaacttccggcccgagttgagcttcctgctccgtgacgtcgaaaccgggacggcggccgggatcgtcctgatcgtctcgtgggaggcggaaacggcggcgaccggcgtccgcgacgcgtatttccgggtcatcgccacgcggcccgcgtacgaggagcgcggcgtggccgaagccctgatctcccacacgctccgggccgcacaggaccagggctacggacgggccagcctcaggggcgacgcggacagttcgagcaaagagttcacgatgtacgagagggccggcttcatcacccaggacactcaggtgcactactgcatcgaactctgacgtgcgcaccgtcgacctcggcgcctccggcatcacaccggtgcagtgctgacgtcgtacaccatcgtcggcgcccgccccctgttgtcggtgcctcctgctacggtctcgccgctggatcgaacgcgagacaggagccaccgatgtcgttcttcgcgaacgccgagaccttcgccggccaggtcgtcgccgactacccgggcggccgaccggacgccaccgcctggtccgtcgcctggcacgacgacgagatggaccaggagggcgtgctctccgacggcttccgcgacatgttcgagggcttcgtcgccgaccggggcgccaccaccgagacgctggtcatcggcgcctggggctatgcggcgttccgcccggccccgatccggcagctggtcgacgccgccccgcgcctgccccggctgcgcgcgctgttcctcggcgacatcaccggcgacgagtgcgaggtctcctggatgaaggtgggcgacgtcagcccgctgctcaccgcgttccccgcgctgcgggccctgcaggtgcgcggcggtgaggacttccggttctccccggtgcgcaacgacagcctgcgccgcctggtcgtggagagcggcggcctgggctccgccttcaccaccgccgtgctcgcctcctcgttccccgagctcaccgacctggagctgtggttgggcaccagcgagtacggcggtgacaccagcctcgccgacctgcgcccgctgctcgacggcacgctgttcccgcggctgcgccggctcgggctgcgcaacgccgagtccgccgacgagatcgcggtcgcgctcgcccaggcgccggtcgtcgcccggctggagtcgctcgacctgtcgatgggcacgctcggcgacaccggcgccaccgcgctgctggccggccagccgctcacccatctgcgccggctcgacctgcgccaccactacatgtccgcggaggtcgccgccgccgtggtcggcgccctgcccggcgtcgaggtggacatcgacgacccgcaggaggacgacgtcttcgacgacgtcgcctaccggtacaccgcggtctcggagtgacatgcgcaccctgatcggcagccacgacatcctgatggtcaccctggacacgctgcgctacgacgtggccgccgagctggccgcgaccgggcgcaccccgcacctgtcccgggtgctgcccggcggccgatgggaacggcgccagtcgccggcgagcttcacctacgccgcgcaccacgcgttcttcgccggtttcctgcccacccccgggccccgactcttcgcggccgccttccccggcagcgcgagcaccgggccggacacctgggtcttcgacgtgcccgacctgcccaccgcgctcgcccggcacggctatcacacgctctgcctgggcggcgtcggcttcttcaaccggcgcaccgcactcggctcggtgctgcccgggctgttcaccgaggcgcactgggagccgtcgttcggggtgaccgctcccgactgcctcggcgctcagctcgaccggctcgcgatctcgctggccgcggtcccgcccgggcagccggtcttcacgttcctcaacgtcgccgcgatgcaccaaccgaaccggcactacgccgggctcgcggaggacaccgtggtcagccacggtgccgcgctcgaatacgtcgacgggctgctgccccggctgttcgcgctggtgcggggacgcggacggccggtgttcaccatcctctgctccgaccacggcacggcgtacggcgaggacggccacaccggtcaccgcatcggtcacgaggtggtgtggacggtgccgtacgcggacttcaccctcccggcggcgtcatgatcgacggctcgccctaccagggctacctgtacgcgtatccgcacaagacgtcgtaccgcccgctcgacccgcgccccgcgctcgccgacgtctggcgcgacgagccgcgcgacgccctcttcctctacgtgcacgtgccgttctgcgagatgcgctgcggcttctgcaacctgttcacccgcaccggcgcccccgccgagcaggtcaccgcgtatctgcggcagctgcgccaccaggcgtcccgggtcgcgctcgacggcgccgtgttcgcccgcgccgcgatcggcggtggcaccccgacctatctggaggcggacgagctcgccgcgctcttcgacatctgcaccacggtgatgggcgcccggctgcccggcatcccgctgtcggtggagacgtcaccggccaccgccacccccgaccgtctggcggtgctcaccgggtacggcaccacccgggtcagcatcggtgtgcagagcttcctggacgccgaggcccacgcggccggccgcccgcaacgccgcgccgacgtcgaacgcgccctcgccgcgatccgcgacgcccgggtcccggtcctcaacctggacctgatctacggcatcgacggccagaccgccgacacgtggcggcagagtttggacgcggcgctcgcctggcgccccgaggagatcttcctctatccgctctacgtccgcccgctgaccggcctgggccggcgcgcggccacccgcgacgactgggacgcccagcggctggccctctaccgccagggccgcgacacactcctcgcggccggctaccggcaggagtcgatgcggcagttccgcctcccggccgccgccgacgacggccccgactactcctgccaggacgacggcatgatcggcctcggctgcggcgcccgctcctacacccgcgacctgcattactcgttcgactacgcggtctcggtcaccgaggtccgcgcggtcctcgatgactacctgtcccgtccacccgccgacttcgcctacgccgaggtcggcttcgccctctcccccgccgagcaacgccgccgttggctgatcaaatccctgctccgcgccgacggcgtcgacatctccgcctaccgtcgacgcttcggcgccgacccggtcgccgacttcccccagctcgctgtcctgtccgacaccggcctcacccaccccggcaccctccgtctcaccccggccggcctggaacgctccgacgccatcggcccatggctcacctcagcccaggtccgcaccgccatggccggataccacctccgatgacggcacctccccgagcatcgggcctcgtccgtccgccagcagccggccgctcccccgccccggcaccggaggctgtcccgccaacccgcgacgccgcccctttcccgggcctcgacggcgctcctcctccgagcgccggggccgctccttccccggcgtccgggggtgatccttctgcgtcgctcgggcttgcgtctgcgccggctgcggcgtccggcctgccatccgcaccggccgcggcaccccgcctgccatccgcaccggccgcggcaccccgcctgccatccgcatctgctgtggcggccggttccgcgccggtcactctgctgccgctgcccaccgtgcgacgaccggcggagccggccggggatctcgcgccgttgccgccaaccctgaccgtgctctaccgcgggccgctggccagctgcaactacgactgcccgtactgccctttcgccaagcaccacgacccaccggccctgctgcgtcgggaccgcaccgccctggaacgtttcacagcctgggccgccgccaccaccgagacccgcctgtcgatcctgttcaccccgtggggcgaggcgctgacccgtagctggtaccgggacacgatgatcaccctctcccacctgccgcacgtcgaccgagtggcgatccagaccaatctggccgcccgccccgactggctgaccgccgccaagcccgatgccctggccctctggaccacctaccaccccggccaggtaacccgcgcccgcttcctgtcccgctgcaccagcctgctgcgcctgggtatccgcttctcggtcggcatagtgggattcccggagcacctcaccgaggcccgagccttgagagccgctctccccccggagatctacctgtgggtgaacgcggccgagggaaagcactacaccccggacgaggaggccgactggacggcgattgacccgctcttcggctacagcgtccgcccccacgcctccctgaaccaaccctgccacaccggcgaatccgtcatctcggtcctgggcgacggcaccgtccgccgctgccacttcatcacaaccccgatcggcaacctgtacgacaattcctggcgcgccgccctccgcccccgcccctgcaccaccacgatctgcgactgccacatcggctacgtccatttgaagcccttggacctgcacaccaccttcgccggcggcctcctggaacgcatccccgccacctggcccgccgccccgacaacaaacaacgccgggcacccccgccgcccgaactaggcacccctcgggcggagaatgaggcacgccgcgcgttgaggaagcgcacctcgaacccacagcgagggccgccgcctgaacaacgcgtccctcccgcggggccgtggggcgccgccgcctggacacggccccttccgcgcggcagtgcgaggcgccgtcgcctggataaagcaaccctcccgcgcggcagcgagaggcgccgccgcctgaacgaagcgcctctccccgggcagtgcggggcgccgccgcctgaacgaagcgcctctccccgggcagtgcggggcgccgccgcctgaacgaagcgcctctccccgggcagtgcggggcgccgccgcctggaggaggcgacggcgccggccggtgcgaaagatcagcggctgaggaatcccggccgccaggcggaacgccgcggcttggccgcccgcttccggagaatcgcggtcgccgccgcagcagccgcggcgagggcaagcaccgtggcggccaagggtttgcgatgggtagtggccgcctgagcaggccgggacgtgcgaaccgcagtcaccgcccggcgaaccttggacggactggactccgactccgccgaatcatacgagtcacgaaccttgtcgggcgcgttcgttgtcatcgctcacctctcctaagtggtggatagggccgctatgccgcacttatgccccttcaacccccgctctcaatcccctctgtcaccgaacctaaccgcacagtcaccccaacgttgtcccccatgcgacagatcccccgacatcaccccacaaccaccaaacccgccatgcgattcgcggtagtcgccgcacccggccgacgatgacctccgccctgccgtagagccctactgaacaggccgaacatgcacgcgtgaccacgcagccacagtcgacggcgacggccggggaggagagcggacgcaaggcgtacaccggtagggcttgactttggggctgccttttcggcatagaagtcaggagggatagaggggagcacgggggccgaacaccacaaggagagcccatgcggatcagtgacatcctgcgcgtcaaaggcaccggagtagtgacagtcccacccgacctctccgtggagggcttgatcgccaagctggcccaccacaggatcggcgccgcgatcgtctcccgggacggcaccgcggtagccggcatcgtcagcgaacgagacatagtccgggccttggccagccacggcccgtcagtcctgaccgacccggtcagctccatccagaccacccaggtccgaaccgtctccccggacgcccaactggaggatgtcgaacgcctgatgaccgacaaccgtttccgccacgtcccggtcgtccagaacgggcacctaaccggaatagtctccatcggcgacgtggtcaaaaatcgaatcgacgagctcgaaaccgaacgcaccaccctcgccgattacataaccggcgatcggacctgacgccctggccggccacacccaacaccacaaaccaagccccgggcgcccacctcccgaaccggaggccgaccccagccaccaccacccacctgctgaggcgaagaccgcgaccgcagccgccacggcccgacaacctcgcgccaccccgaacaagcacacaagaaaggcccacccggatcccggaatgggcctgaaaagacaaaaagaaacgcccacccgttcccgggtgggcgtttcttcaagttgagtccggcggcgtcctactctcccacaccctcccgagtgcagtaccatcggcgctggagggcttagctaccgggttcggaatgtaaccgggcgtttcccctccgctatgaccaccgaaacagccatcagcagaacaaaccagcaacccggcactcttgaaccggggtggttgttcgtttgctgtgaatcacacagtggacgcaagcagaaaatttagggctagctagctagcccgccattctcagttcgtcaaatccgtgtttcgcaacccgaattcaccacaccgagaaccccgcgatcgctagaccgtgagatgttgcaggatttccgtcaggacggccggcccgagcccctcgcgggtctcgttcgctcgcccgtctccctggcggctcggaaaacattacccgcagctcccggcaactccaaatcgtccgcatgagacggcggtcacacccgaaggtggctccgaaccctcaggtcgcggccatccgggccgcgcccgacggggacggtgcgggcggcacccgtcgctccgtaggtccaggagaggagactcggtgcgtccaggacaagaagactcggtgcgtccaggacaagaagactcggtgcgtccaggacaagaagactcggtgcgtccaggacaagaagactccgtgcgcccaggacaagaagactccacaggcacggaagacccggcgaggcgggacgccaggagtcgccggcaccccgcccacacggaaggctgagcggcgcgcgcagcgaaagagacgtacgcgcaggaaggtcaaggaacacaagacgtgcgcgcttggcgtataacgagcagcatgcgcacttttgagctggccgagatgctgcgggaggtgcccggcaccgaggtgaccgccgggccgggtctggtcacggtgcacatcccggcgatcggtgacactctccggatcgcgttccgcgacgttctcgacgccgactgggtgcatgtacccaccggcgagcccgccgtccaggtcgacctgcggcgcggacaccagtcactgccgctgatcatcaccgtggacgacgtcgtgttcaccccgtcgtacgctgatgatcttgttgatccggaagaccacctgctggtgccggcgatgccgagtctgatcgcctactccgagatgcaccgggacgtgcgggcactcgggaaggcgctcgacgacccccgggtgcagctggctgacgaggtgctggcggcgaccctcaccgcgcatcggtgtttcctggccggagcgatgcgggtcgggctctggccggtgcgggtggcggcatggtgggaatacacgtccgcgcggtcggccgggcaggtgcgggtggcgcggttcctcccggatccgcgctgggacgagttgatgcacggggtccaggaggctcgccagacgcagttcgaacaggagaatctgcgcgtcatccggtgaggcgagcggcgcatgcgcagttcgccggcgggtggcgtcgcccggctgacccgccgggcgacgcgcgccttcagatcaacaccgggtgcgcggcgttgcggttgaccgggcgcggcagcccgtagtgttcgcgcagcgtccgccccgtgtattcggtccggaacagcccgcggtcctgcaggatcggcaccacctgctcgacgaagtcactgagcgacgagggcagcaccggcggcatgatgttgaagccgtccgcggccccggaggcgaaccagtgttcgatctcgtcggcgacttccaccgcggtccccgcgaaggtcaggtgtccgcgtcccccgcccatccgcgcgatgatctcgcgaaccgtcaggttctcccggcgtcccaggttgacgaccagcgtccgccggctcttggcgccttcgatctcgtcctcgtcgggcagttcggcgggcagttgttcgtcgagccgcaggcttgcgaccggcaccccgagcaggccggcgagttgcggcagcgcgtattccggcttgatcaggcggttcagttcggcctctttggcctgcgcctcggccgaggtggccgcgatgaccgggacgatgcccgggaggatcttgatgtggtccgggtcgcggccgaattcggcggcgcggcgcttgaggtcgtcgtagaactcctgggcgtcggcgagggtctggtgcgcggtgaacaccgcttcggcgtacttcgcggcgaaggtgcgcccgctctccgacgatccggcctggaccagcaccgggtgtccctgcgcggaccgcggcacgttgagcgccccggccaccttgtagaagtggccctcgtgcgccgccgggtagatcttgtcggcgtcgccccagaccccgttctccttgtcggcgagcaccgcgtcgtcggcccacgagtcccacagtttcagggacacgtccacgaattcggcggcgcgctcgtaccgctcccggtgggcgggcaggtggtcgaggttgaagttgcgggccgcgtcgaggtcggcggtggtgacgatgttccagccggcccggccaccgctgatgatgtccagggaggcgaagcgccgggccaggttgtacggctcgttgtacgtggtggacgcggtggcgatgagcccgatccgctcggtggcgccggcgagcgcggtgagcaggacggtgggttccaggacgccggaggggcggcggccgacctggttccacaggacggggccgtcggcgaggaagaccgagtcgagtttgccgcgttcggcgatccgggccaggttcttgaagtgctcgacgtcgatgtcggcgtgcgggtcggtttccgggaggcgccaggcggcctcgtggtggccgacgctcatcaggaacgcgttgaggtggagtctgcgcgggacggtcatcactgcaccttcggcgtgtagtgggtggcctcgtcgccttcgaggatgtagctcttggtgccgtcgacgccgaccggcacgtcgccggcgacggtgacccggtgcagtttgcgggcgaggtcgccgtagtcgtcggcggcgtagtgctgggtgctccggttgtcccagacgaccaggtcgccgacctgccacttgtggcgcagcgtgttctccgggcgggtcacgtagtgctgcagcaggcgcaggatgtcgcgggcctcggtgcgggacaggccgatgatgccggtgacgaagttgccgatgaacaggttcggcacgcccgagtcggggttgacccgcacgaccgggtgggcggtgcggtaccgggtggagacgaacacctcgtggtacttctccacctcggtggagcggaactgcgggtgctcggcgtagtcgtactcgttggagtgttcggcccacagccggtcggccagtacgcgcaggtgttcgggcaggtcggcgtaggcggcggcggtgttggcgaacagcgtgtcgccgccgtgttccgggatgacgaggctgcgcagcgtggtggccttgggcggggcgacgacgaaggtgacgtcggtgtgccaggcgttggcgcgggcaccggggccgccggcgacttcgaggacgttggcctggccgtcgacggacgggacggtcgggtgggccagggtcaggtcgccgaacagggcggcgaagcgctggtgctgctcgtcgtcgaggtgctggtcgcggaagaccaggaccttgtgcgcgacgagggcctcgtggatggcgcgggcgtcgtcctgggcgaccggctgcttcaggtcgatgccggtgatcgaggcgccgatccggccaccgatccgggtgatgtcgatgctcattgtcgaagcccctttcttaggacgtgcgccaggtggagaagcggcgctcgatgaggatgaggatctggttcacgatcaggccgatgccggagatggtgatgattccggcgtacatgtcgggtaccgcgaagttgtattgcgcgtagttgatgaggtagccgagtccggctttggcgccgaccatttccgcggcgatcagaatgaggatcgagtaggcgccggccagtcggatcccggtgaagatggtgggcaccgcggccggcaggatcaccttctggaatagacgggccgggccgaggccgagcgaccgggccgatttgatcagcagcgggtcgacggtgcggacgccgctgacggtgttgagcaggatcggccaggcgcacgcgtacacgatgatcgcgatcttggaggtttcgccgaggccgaggatcagcacgaagaccggcaggatcgccagggcggcggtgttgcggaagacttcgagcagcggggtcagcaggttggcgaccggtttgtaccagccgatcagcagtcccagcgggatcgagatgacgatcgccagaccgaatccggccagcgagcgggtgaggctggcctccgtgtgctccagcagttcgcccgatttgaccaggtcccaccaggcgaccaagacctcggagagcggcggcaggaacgtccggtcgaccaggcccagccggggagagatctcccagatcagggcgagaacgacgatggcggcggtacgcgtgaccacgctggacagcagccgcaccacccgccggccgaccggcggcgcggtgaccgccgaggtcgcggcagacgggaagatgagggtggagctagacacgggtggcctccagttcctcggtgcgggccttgctgacctcgtcgcgcagcaggctccagatctcgtggcggtagtgcgcgaactgcgggtccgagcgcaggtcctcggtggccgagcgggcctggatcggcacctcgacgacgtccttgatccggcccggccgggaggtgagcacggcgacgcgctgaccgaggtagaccgcttcctcgatgccgtgggtgatgaacacgacggtcttgccggtcttctcccagatcttgagcaactcgtcctgcaggccgtcgcgggtctgcgcgtcgagggcggcgaacggctcgtccatgagcagcacgtcggggtcgaaggcgaggctgcgggcgatcgcgacgcgctgcttcatgccgccggagagctcgtgcgggtagcggtcgtggaagccggtcaggccgaccaggtcgaggtattcgcgggcccgggacgcgcgctccctgcgcggcacgttcttggcctcgagtccgaattcgacgttgccctgggcggtccgccacggcagcagcgcgtactgctggaacaccacgccgcggtccaggccggggccggtgaccggcttgccgtcgaccaggatccggccgctggtcggttcggcgaggccgccgagcaggtcgagcagggtggatttgccgcagccgctggggccgacgatgaccaggaattcgccgtcctggacctggaggttgatgtcctgcagcgcggtgaccgtggtgccgcgggcccggaaggtcttgccgacgttctcgaagacgattttcgcggtcatgcggcaccgcccgcgttaccgttgtacctgttggtgtagatgtcggcgggcttgatgctcttcttcagctcaccggcgcgggacagccagtcgatccaggtctggaattcggtgtcggtgatcgcgccggcggtgccggccacgccgtagctcttgaagaactgcagcgccgagttgtcctcgttgcggccgcgcttgccgacgatctcctggaacttggcgatgacctggtccttgggggtgctccgggcccattcgatggccttgcccacgcccgtgacgaaggtcttgaccgtgtccgggttcttcttgaggaagtcgttgcggaagatgtagctgcccgcggtgaatttgccgagcagctcgaagtcggtgaacagcgggtggatgccgccgcgggtgagcgccttgtcgcgcagcacgccaccgagcgcaccggcgtcgatctggctctgccgcaccgactgctcggtgttgaccggcggcaccacgatcagctcgacctgcttgatctcggcgtcggtcaggttgttcttggcgagataggtcttgatcaccgcttcgtggtgcgccccgagggtgttgacgccgatcttcttgccgatcaggtcgcgggcggtcttgatcgggctgccgtcgagcacgtagtagccggtgtaggtgtccttgtcgacgccgtagtagccgatcaccgcggtgatcggcgcgccgttcgcggccagtttcacgatggcgccgttgaaggcgccgccgaagtcgacgtcgccggtggtggcggcctggatgtcctgcgggccgctgatcgtgttgccgatccacttgagtttcacgtcgccgagatagcccaggtcggcggcgagttcgggcagcgtcacctggcccacgttgccctgatatcgcagttccttgacctggctgccggaggccgaccccccgctcgaaccgcatgccgcgactccggtggcggtcagaaaggcgccgccgagcaggccggcgagtgcgttacggcgagttgtcatgataaagactcctatttgcgtgggggcagcattcatcaagcgaccgcgggtggcggtcgccgcagattcgttgcggaagacctacagcgacatcccgcgcttcagtacgcggttgctgcggccggcttcgggcggcggctgggggcttcgccgtcagagcctcaacaggcgcaggtgcacacctggaggtagtcgacgaagcgtcgcctggtgaggcgcttgctccggttcatgcctaggaacgtaaacggccggcgacgcgcagtcagctactttgtgacccaggtcacatacttttcccatagggtgagtgggaaatgggtcacgaaaaagggcgggagcatcgccacgctcccgccctttaccgctgcgaccaggtcagtcgtcgtcaccgaagtcgaagatctcctcgaccgcctcgccgatcacgaaaccggccgccagaccgccgaccgcgcccaggacggacccgcccatcccactcccgtggtggtagtggccgtggtgtccgtggtggccgccgtggtgcccgtagccgggcgggggcggcgggtagccgggagcgccgtaggccgcatgcccgccgtagcccggccgggaccggtgcttgtcgaccgcctggcgcacccagccgtccacgaccgagcgccagtcggtggtctccgcgtcgtggtgggagacggtgtaccgcccgtaggtgtcgtgaccggagtggaacagcccaccccgcttgtcgaactccaggaccacctcgaccgcgtgcgggctggtcacgaacgtcagctcgacctcgttcaccgcgtgcgcgtactgcgcggccggccagtactcgatctcctggtagaacggcagggtctggtggacgccgtagatctgcccgtactccaggtcggcggacttgaagcggaagcccagctgaccgaaggcgtccagaatcttctggtggatcggcagcgggtgcacgtagaccgggtcgagatcacccttgtccagcgcccgggcgatcgacacctcggtgcgcacacccatcaccatgccgcgcagcggctgcccgtacgccgtggtgatcggcgtctcccacggcatgtcgatgcggaacgggatggacatctgctgacccgggtggatccgggtcgggccggacacggtcagccggtagaagtcgccggtggtcgagtagtcgtggccgccgccctccacctccatccgggtgaccagggccagggtgatgtgctcgatgtcggcgacctgggtgccgccggtcaggttgacctgaccggtcagcggagcacccgggtaggtgctcgggttggccagcacggtgtcgacgctcggcccaccgactcccatggcgcccagcaacttcttgaagaccacgatgctctcctgtgcgtgcccgacctaaggacctaacaaggccgaagcgtacgactatcgtgcaaggtcatggagccagtagtggtctacgacctcgcggaagtcaccgtcacacacgagccgggtcacccggacgaggtggtcgccgggcagccgtccaccggggcggtgagcgtcaccacgctcgacgggccgggggtcgagatcggtatctgggagatgaccgtgggagcggtccgcgacaccgaggccgaggaggccttcctggtgctgtccgggcgcgcgacgatcgcgaccggtggcgagacctacgaggtgaagccgggcgacctggtgcgcctgacggccggcacgccgacggtgtggcgggtcaccgagccgatccgcaagctgtacatcaccggacggtgaccgggcggctcccgccgcccggtcaccgggtgtcacttgatcaggccgaggccctgcacggcggcgcgctcctcctggagctcggcgaccgaggcgtcgatccgggcgcgggagaactcgctgatctccaggccctggacgatctcccacttaccgtccttcgcggtgaccgggaaggaggagatcaggccggccggtacgccgtacgacccgtcggagacgatcgcggccgacgtccagtcgccctcggcggtgccgttgacccaggtgtgcacgtggtcgagggcggccgaggcggccgaggcggccgaggacgcgccccggacctcgatgatctcggcgccgcgcttggcgacccgcgggatgaactcgtcggccagccaggcctggtcgaccaggtccttgacgggacggccggccgcctcggcgtggaagacgtccgggtactgcgtggcggagtggttgccccagatggtcaccttgcgcaggtcggcgaccggcacctgcagcttcgccgcgagctgggccagcgcgcggttgtggtcgagccgggtcatcgcggtgaaccggtcggccggcacgtccggcgcgttctgctgggcgatcagggcgttggtgttggccgggttgccgaccaccagcacgcgcacgtcggacgcggcgcccgcgttgatcgcggcgccctgcgggccgaagatgccaccgttggcctcgagcaggtcgccgcgctccatgcccttggtccgcgggcgggcgccgaccagcagcgccacgttgacgccgtcgaaggccgccttcgggtcgtcgaacacgtcgacgctgctcagcagcgggaacgcgcagtcgtcgagctccagggcggtgccctgggcggccttggcggcggccgggatctccagcaggcgcaggcggaccggcacatcggcgccgagcaggtggccggaggcgatgcggaacagcagcgcgtagccgatctggccggctgcgcccgtcacggtgacggtgaccggtgtcttagtcatgagttagtctcccgaggttgaggcattgcggcacccgttgcggactctatccctcgcgttaccggacgatgacgcggatgcccgcgggtgtgacctcccgcgttaacctaccgccgccgacggatcgacgcccaccacttctccactgtggatctcgggtgttttccgggacggctgccggggcataaggtgccagcgtggccattctggcgccgccctatcggcccctgtcccccggtttcccgccgctcgacccggcgcgcggcgacggcggcgcgaccatcgccgtgacgatgcggttcgcgccgctcgccttcctgctcggattcttcaccccggtgctggagatcgacggcaggaacgtgccggccacctggggccgggtgagcaccccggtggcgctcggcgagcaccacgtgcacgtccacgtgccctcactgctgccgtcccggctcggcgcggccgagaccaccgtggtggcactgcccggccggaccgccgagctggagtaccgcgcgccgatgctggcgttcctgcgcggcgcgctcgggccgccgccgcagaggtaccccggcatggcgctcgcggtggccctgctggtggccgcgacaaccgccgtgatctgcggatgtttcggcctgttgacctccggtcactaggcgacgccgggtagagtcggccgaggcgacgactgagggcttgtggtgacggtacagatctggcgcacggtgacggtgggcgcggcggctgccctggtgaccggcctctgtctcacggtcgccgagctcggccgggaggactccgggccggtctgggtgcagggcaccgaggcgtccagcgagccggtgactccgggcgcggcgccgccggtcacccacctgccggtgcggagcgcggcccggaccacccggcccggcaccaccaccctgccggaccgcgacgacgccgccgcgatcgacggcgacgaggccaagggcgaggacggcagcggcagcgatccgcggttcaccacctgcgccgaggcgaccaccaagggcttcgggccgtacgtgcagggcgccgacccggaatacgactggtacccggacccggacaacgacggcaccgtctgcgagtagggcctactgcagctcgtcgtgcagcgcccgcatcagctcggcgctggtgaacggcttctccagcaggtgcatctcggccgacagggtgccatggtcggtcagcaccggctgggcgtaacccgacatgaacagcaccctggtaccgggatgccgggcggtcaccgcctcggccaggtcccggcccagcatccccggcatgatcacatcggtgagcagcacgtcgatcgggtgctcgtcgaccagccggagcgcctcggccccgccggatgcggccagcacggtgtacccgccccgttggagaatgcggcaggtcacctcgcgcagcgcggcctcgtcctcgaccaccagcacggtggcgccgtgcccggtcagctcggcaccggtctcctccgccgcggccgcctgcgcccgcacgtcggtgaccggcagcaggatggtgaaggtggtgccgatccccggttcggagtagatctgcacggtgccgccggcctgagtgacgatcccgtacacggtggccaggccgaggccggtgccctgaccgctgggcttggtggtgaagaacggctcgaacgccttgtcgatcacctcctggggcatcccggtgccggtgtccgagacgcgcagccgcaggtatcggccggggctgagcccggcgcgggcggccgagtgctcctcgtcgacgctgacctcggcggtgtcgatggtgagccggccgccggtcggcatcgcgtcccgcgcgttcaccgcgaggttgaccagcacctgctccagctggccggggtcggccatcacggcgggcagcgcctcggcggtccggacggtcagcgtgatgtgctcgcccagcgagcgttccagcatctggtgcacctcggtgaccaccgcgttgaggtccaacggccggggccggatcacctcccgccgggcgaaggcgagcagctggtgggtgaggtcgctgccacgccgcgcggcccgggcgatctgctcggcgtcggcggccggcgcgctgcccgccgcgtcctcgatgatgaacgccgcgtagttgaggatcaccgcgagcaggttgttgaagtcgtgcgcgatgccgccggccagctggcccaggctctccagccgctgggcctgctgcatccgggcctccaggcgctgccggtcggtctcctcacgcagccggcgccgctcggcctcgatggccagccgctcggtgatgtcccggaccgcggccaccacgatcatcccggtatcggtgtgcagggcgctgaccgcgatgtcgaccggcagttcggcgccgtcgctgcgaaccgcccgccgcttggcccaccgctgctcaccaccaccggcccgctccggctcccgagaaacggcgccaccggcccgctccggctcccgagaaacggcgccaccggcccgctccggctcccgagaaacggcgccaccggctcgcaccgggtccagcggagcggcgccgccgccggtgcgcagcatcgcggagatcggtggtagcccgtccggcagcagccgggacacgtcggagtggatcaggtcgtgccggggatgcccgaacagccgctcagcctccgcgttgaccagcaccacccggccgtcctcggtgactccgagcatcgcgtccggcgccgcgtcgaggatcgcctggacccgggcttcggcccgctcccgctcggtgatgtcgcgcgcggttccggtggtgccgaccagcgtgccgtgctcgtcgaagagcggggagaccagcatggcgaccgcgatcggctgcccggaggcggtcaggcgcagcgaccggtaccggtcgacccgggcgccgagccggaccagccggcggatctgtgcctcgtcctcccgccggtccggcggaatgatctcgtcgacgtcgacgccgatcatctcctcggccttgaagccgtagagcatctcggcgcccggattccaggacagcacccggtcgtcgaggccgaccgtgacgatcgcgtcgtgcgaggactgaacgatcgaggcgagcagcgcgcgggtggccgcggtctgccgctgggtggtgtcgtcgcgcagcaccgcgatcgcgtacgttccgccggtgccggccggggtccacgacagcgacacctcgaccgggaaagtgcggccgtcgcggcgcacgccgagcagggggatgcggcgcatcggcgtgccgcacccgtcacgcccgttgccggggaccagctcgtcgaaggggatgccgggcaacgcaccgggtgggtagccgaacatctcgtgggcccgccgattggcgatcgtgacgacgccgtccgcacggctcacgatgatcgcgtccggggcggtgtcgatcaggagccccggcagctcgttgcgtgactccacacccgtcccctcccgtaccaaagtagcattaatgccttcaattcgggctacctttggggcgtgagcatcgatccgaaccggcccagttccgcccgggtgtatgacgtgttcctgggcggcacgcacaacttcgcggtggaccggtcggtcgcctcccggatcgccgagctggtccccgagatcggcgccgtcgcccgggccaaccgggcgctcccgcaccgcgccgtccgctacgcggcggcgcgcggcatcagccagttcatcgacctcggcgccggcatccccaccgagggaaacacccacgaggtcgctctgcggacgaaccctgaagccaggatcgtgtacgtcgacaacgacccgaccgccgtgctctacgcccgcgacctgctcggcgacgatccgcggaccgtggtcgtcgaggccgacctgcgcgatcccgcgtcggtgctcagcgacccggggctgcgggtgatcgatcccggtcgcccggtggcgatcctgatgctggcggtgctgcacttcctgcccgacggcccggtgctcgacgccgccctgcacggctaccacgccgcggccgcgcccggcagcctgctggtgctcacgcacgccagcggcggggacgccccggagacggtgcgccgggtcgccgacgtctacaaccggaccggcacgccgctggtgccgcgcgacacgcagtgattcgcccggctcctcaccggctgggagctggtcgagccgggcgtcaccccggccccgctgtggcatcccgatccgggcggcgagtcgatcaccgacccggccgcctccctggtcctggccggcgccgggctccggacctgaccaccctcaccgctgcggcgaccggccgccctcggacctgaccactctcaccggcccgggcggcgccgggccgcggggctgagcacatcggtgtcggccggccgatcccagccgtcacagcagtcctccggctccacctcgatcaaatcgaacaggtcgggcccggtgtgcccggtgtcgacggtgccgccgatcagccccatcagggccgcgcagttacgcccgtatccctgcaccatccggtccacacgggtcgggtgaccgcagcgacgacacggtcgcatccgctccatcggacggtcacccacccgatcattatcgccgggacggcggctccgcgcccggcccttcggcggtgaatcccgcctcggcggcgatctgcgcgatccgggccagcaccccgcgcgggtcgtcgtgcgggctggtggccagctcaccgacccggcgcagcaggtccggcaggtgtccgccgggcagcggccggacccgttccacgatgcgaagcagggcggtgagctcggcgatgatctcccggaggctgtccgggttgaggctcccgatgacgaccggctgccggtcgtcatcgggctcggccgcacccggggcgcgcaacacgccgagccggaacccgatcgccacggcgtgggcctggtcccgggcgcccagctgctgatacagcgtacgaaggcgggatttgacggtgttcggcgacagatagagacgtgcggccatctcccgggcggtctccccggccgcgagcgactcgatggtttcctgaaggtgtggtgccagcaccggccgatgcgcaacagccctggtgtggcttcgatgcgtttgcagcgacatgcccgagaatgtagatcttgccgagtccggtgtgatccacacctgcgccgatggcgtcagccctcgccgaccgccttggcgagctcgtccttcgtcatcttggaccgccccggaatgtcctgctccttggccttctcgtagagctcgcgccgggtttcctcgtgcccaccggcgggcggcgtgccctgcgtcgcctcctggaagcgccgccccagctcctcgcgctcctcggcactgagccgctcggccagcaccggcagcagctcctcctcttcctcctgcacgtggtgccgcagctcgccggtgatcgccgccagggtgccgtcccaacccgggtcgtcggggctgccgtcgagcaggttcttcagcatctcctcgatctggtggtgctcctccaccccgtcggccacctcctcaccggtctccgccgccttgtcgcggatggtggggtagacgaagctctcctcggcctcggagtgcggcagcagcatccgggccacctcctgcagcagtccgagctgatcggcgtcctcctcggccgcctggctcagcagcgcgtcgacctgctggtgctgcgccttgatgatctccacgatgtccggcacggatccccctgtagctgagttgaccttgccgaccggagataccccgttccgcgccggccatccatcgcactgccaggaaacactcaactcggcgacggtagtctcccgggccgagatcaacttcttcgtcggaggtgcccgctgatgtcagcgttccggatgttccgcgcgacggcgatcgccgaggcgttctcctggaccggcctgctgatcgggatgtacctgaaacacgtctcgcacaccacggacgccggcgtctggctcttcggccgcatccacggcgcccttttcgtcgcctacctcgccgccaccctctggaccgcccgcaccgaacgctggtcactgtggcgcaccgccttcgccctcggcgcctcgatccccccgctggccaccctgctcttcgaacgttggctcacccgacgccgccccaccccgctgcccgcttgagcaccatgacgatccgattgccgcgtacgccaccatccgcccgccgcgctcaccctccccgccaggccggccaggcctccccgccccgccacgccggttctccggactacggggccggggtcaacctccccgccacgccgggccttctcgccacgccacgcgccgggtctgtcaccacgcggaccgggtcgggtcgcgcctagcctgcccgccgcgccggggcgggccgcgcccagagctcgcgccacgccgcggccgcaagaccgccgcggtgcgagccgggccgcggccacaagaccaccgccgtgccggcacaggcggcagccgccagaccgccgaggtgtggaccggcttcgtccgcccggcggccgcacggcccgggctacttcaccgcgatcgggttgaccgggctgcccaccgccccggtgatcggcagcggcgccgcggtgagccagaaacgccgcccagacccaggaacacggtggccgagaccgaggcgagcagcgtctgcaggcccaggtagcggcttcgccgcgggcccggccagtagtccgcgatcagcgtggtgcagcgggtcatgatcgcggcttcgcagagtccgaccaggacccggctgccgatgatcgcgggcagtgcgtcgaggtagagcggggcgatgccgcagatcgcgatcggcggctcgggctggcgggccccgttctggctctacaccgtcgcgctgctgctggccgtgccgatggtcccgctgatccggcagccggcccggcccgcctccgctcctgcgggtcgtgagctgccgccgctgccctggcgccggttgcgcaccccgtgtctggtcaccctcgccggcggcgtcgtcttctatgccctgatcgtcgagctgtccttcgtcctggacggggtgggcgtccagcaggccgcgacgatcggcgcgctcagcgccctgatgtcgttggccaccgcggtcgcggccggctcgttcgcgaggctgtccgggcgcaccccgcgccggctgctgccgatcgccttcggactcgcggccgccggtttcctgctcatcgcggccaccccgcgggttccggtgatcaccgccggcgccgtgctgaccggggccggtaccggcctgctgctgcccaccctgctcacctgggccaccaacaacctgggcttcgaggaacgcgggcggggcaccggcctgtggaccggcaccctgttcgtcggcgagttcttctccccgctgctgaccagcggcctgtcggcggcggccggcgggctgcgcccggccctgggcgtcgccacggccgtgctggcggccaccatgccgctgatcgtcccgcgcaccgcgggcgccctgaacgtcacccgcgactgacccggcgcccgccggcccccggcgatcggctcggttctccaccgcgatcgccggggccggggtcacccgacgtagacccggccggcgccgtaggcggtgccggcgcggtcgcgttccagccagccggtctcgaccagcatccggcggacggccgccacatcctcggcgaccaccgcgatccgccggttcacctcgtcctcggtgagcaccccctcgaccgccaggaagcgggcgagcagctcgccgatctgctcgtaacgctcgctgagcgtcggtggcagactggtcaggaaaccatgcgtgaaatagcccttgagctgcggatactcgcgcagcagcggagcgatcggcagggtcgcgaccagggcctgggccgcgtcgcgcagcacctgaggcgtggcccggtaataaccgtcgccggtgccgctggccagccccagtgcggccagccggcccagtgcctcccccgcctcgggcttggacatgtccagcaggaaggacatctcggcgatcgagaatccctcgctgccccggccgaccagaccggcgaaggcgcgtaggcgcgcggggtgggacagctgggtgagaagctcggcggcgcgagctgcttcggcggacatccccacaacctaggacgggcgtcccggcacggcatccgattatccgcgcgccccggatgaccgctgccagggccgtcggcccggatgctcacccggctgtcgacgttcgccgatggttccgtcgtatgtgatcgatatgctcggcgccatgtctccgatctcccgccgggccctgctcggcgccgccgccgcggccggtggtggcgccgccctcggccccgctgccctgccctcgcttccggcccaggcggccggcagcctcgaccaggtgcagcacgtcatcatcttcatgcaggagaaccggtcgttcgaccactacttcggcaagctctccggggtgcgcggcttcgccgacaccagcctgctgcgcttcccgtccggctcggacgtgtggcaccagaagcgcgcgaccggcaccgtgctgctgccctggcggctggacaccaccaagaccgacgcgcagcgcatctccgatctggaccactcctggtcgggcacgcactcggcgtggaacagcgggaagtacgacaactggatcccggccaagaccgagaagaccatgggttactacacccgcgccgacatcccgtggcagtacgcgctggccgacgcgttcaccatctgcgaccagtaccactgctcggtgcagggcccgaccaacccgaaccggctctaccagtggtcctgcacgatcgacccgaacggcgggcacggcgggccggtcaccgacaacaccgaggccggctactcctggacgacgtatccggagcggctgcagaaggccggggtcagctggcgggtctaccaggaggcggacaactacgacgacaacccgctggcctggttcacccagttccggaacgccgccaccacctcgccgctgtaccagcgcgggctgctcaaggcggcctcggcgctcggcgcgttcaccgccgacctggccgccggtacgctgccgcaggtgtcctgggtggtggcgcccgcggccaagagcgagcacccgcagtacccgccggcctacggcgccgacttcgtgcagggcttcctgtccgccctggccgcgtacccggacgtgtgggccggcacggtcatgttcctcaacttcgacgagaacgacggcttcttcgaccacgtcgcgccgccggttccgccggccggcaccgcggacgagttcatcggcggcaatccgatcgggctgggcccgcgggtgccgatgacggtcatctcaccgtggagcaccggcgggcgggtctgctccgaggtgttcgaccacacctcgccgatccggttcgtcgagctctggaccggcgtgcgggagaccaacatctcggcctggcggcggaccgtctgcggcgacctgacctcggcgttcgacttcacctcgaaggtcaccacgttcccgtcgctgccggacaccgcggccctggtggcggcctgcacccagcaggacagcctgccggacgcgaccgcgccgaccagttcgacgctgcccgggcaggagaccggggaccggccggcgaacccgatcggataccggttgaccaccacgtcgtggacggacaccgccacgaaccggttctggttcaagacggtgaactccgggtcgatcggggcggggctcaccgcgtacaccgtcaatttccgtaaatatcagacgtggcagtacacggcggcggcgggcgcgacggtgtcggactacttcagtgcgctcacctacggcggcggcccgtacgacgtcgacctccacggaccggacggctacctgcgcggattcaccggcgacgtgcggacctggacgaacaccacgaaggcgcaccccgaggcgtccgtggtcgaggacggcgcgatggggctgaccctcacgctgaccaatcagggcacggtggcgaccaccttcacgatcggcaacaaccaggtgtacggggcgtccagcggcccggtgcgcaccgtgaccgtggcggccggcgggagctcgaccctcacgctcagcacgctggccggtcggtacgactatacggtgacggccagcgtgggtgacgggttcggccgccggttcgccggccgcgtgtaccggtgacccctgatcagatctcgtcgaggacccgctgcgcgatccggaaggcggtgttggcggcgggcaccccgcagtagatcgcggtctgcaacagcacctccttgatttcgtcgacggtgaggccgttcgtgtgggcggcgcgcacgtgcatggccagctcctcgtgatgtccgagagcgaccagcgcggtcagcgtcaccaccgaacggctgcgccggtccaggccgggccgggtccagatctcgccccaggcgtaccgggtgatcagatcctggaagtcgcgggtgaacgcggtggtcccggcggtcgcccgatcgacgtgggcggccccgaggacctcccggcgaaccgtgctgccggccgcgcggagctcgtcgaagtgctggtcgagcaggaacgcgaccacctccggggactcggccggggccaggtgggcgaccccgtcgaggatgaccagccggccgtgcagcacaccgtcggcgatcaggcgcaggccgtcggcgggcgtcggccggtcctgaccaccggccacggcgagcaccggggtggcgatctcggcgagccgatggcgtacgtcgaatcgcgccagcgcctcgcagcagcgggcatagctctcggcatcggtcgcgcgcagcgcccgcagcagcggctcgcggccggccgccgggaagccggcgccgaaccagcggtcgtcggacccggcgacgaccgcttcgacaccctccgcccggaccagcgcggcgcgctcgtgccaggcctccggctgaccgatcctggccccggtgcagagcagcacggcggcggtcacccgctcgggcgcgtcgagcagcagctgcaggccgatcgcgccgccgatcgagtcgccgccgaaccggaaactctcgcccggccgcagcctgtcggccaggtcgaggaccgctcgggccaggtcggggatggtgaacggcgcgtcggacggggcgctgcggccgtggccgggcaggtcgaagccgaccacgtggtagcggccgtacagacgggacgcgcagtccgcccagagggtctcggccgaggtgccgaccgaggagccgagcagcaggagcgggcgatcgggggcgtcggtgaagacggtcgcggtcagcacgagagtcccttctccggtgcggccgtggcgcgggccagagcggcgtcgatgatcgcgtcggtggcgccgagatagggctggtccggagcgacgcccggggtgatcgactgctgttccgcgtcgatttccggccgcgcatcgtgcagggtggccagcatccggccggtgtccacgcgcaggccggcgagcagctcggcggtctgcgccccggcggtcaccgtgtgccgggcgagggtgcgcagggtggaccactcgacgtgccagccgccgtccgggcgttcgtcgacggcggccgccgcgcccgcgtggatcagcgcggccagcggcggcccggccagtgcggcccgcttgatcagcacggcgtgcaccgggttccgcttgttcggcatcgccgacgagccgcccttgccctcggcaccgccctcgatcagctcgtggatctccggccgggagccgaccagcacgtcgttggcgatccggccccacgcgtcggtgcaggtcacgaacgcgtcggcgacccgggtgagcggggcccggctggtctgccacgggaagcgctgcggcaggccgagctcgcgggcggcgaggaccccggtcagccagccggccgccttcagtccgaaggtgatcgggacggcgtgctgggtgagcgtccgcccggccatccgggtctcccggtgctcgtcggccagccgggacagcgcgccggtctgggccagcagcgcgccgcggacccgggcgaccgcctcacgcaggcccagcacgatcgccgtgtcgacgacgtcctggctggtcaggcccttgtgcagccatcccgcggcggcggtgttgcggccgcgcaaccgggcccggagcagcttgagcagcgggatcagcgggttgccgcccgactccgcgtcccgggccagggcgggcaggtcgtccggggtgaccaggccggccagctcgtccggcgcggggacggtgatgcgggccaggccggtctcggcgagcgcggtgagccaggcgtgctcgacccggatcatcacggtcaccacggccgcgtcggtgagcaggtcaccggcccggtggtcgccgggccacagcagatcacccaccgagactcatgcccaggcgtcccgcaggcggggataggtcacgaagaccgtctcccccgcgccctgcagccggacgtcgaagatcaggccctgctcgtcgcgccgggcgatcagcgtgtcgcggcgggccgggtcgaccgcggccagcagcgggtcggcggccagcgcggccggatcgtcggggaggtaggcgcgggtgaacaaccggtccagcaggccgcgggcgaaaaccgtcaccgcgaagaacgccgggcgttccggggtggtccggcccggctccacggtggcgaaccggtaacggccgtccggatcggtggcggcccggccccagccggtgaacgtccacccgtcacggcgcaacgacccgggctgccgcacgacgtgcccctgcgggtcggcctgccagatctcgatcatcgcgtccggcaccggttcgccggcgccgtcggtcacccggccgtgcaaccgcaccgcccggggatgcgccgggggcaccagctcgttcatccccggatattccagacccaggtggaagaaggggccgacggtctggcccggtgccgcggtcatgcgtggtcctcggggtcgagcgtgtcgagcggagtgcggtggctgccggtgagcacgatgtcccaacggtagccgaggctccactccggggtggtcaggtcgtggtcgtaccgggcgatcagcagctcccgggacttcggatcggtgatcgactggtagatcgggtcgagcgcgcacagcggatcgcccgggaagtacatctgggtcaccacgcgctgggtgaattcggtcccgaacagcgagaagtggatgtgcgcgggacgccacgcgttccggtggttgcgccacggatacggcccgggcttgatcgtctggaagcggtagttgccgtccgcgtcggtcaggcaccggcccaccccggtgaagttcgggtcgtgcggcgccggatgctggtcacgctggtggcggtagcgccccgcggcgttcgcctgccacacctcgaccagttggtgggcgaccgggcggccgtcgccgtcgagcacccggccggtcaccacgatccgctcgccgagcggggtgccggcgtgctggatggtcaggtccgcctcgtcgtcggcgacgtcgcggtgcccgaacgccggggcccacagctcgaccgactccgggtcgatcggctgcggcggctgctgcggatgccgcaggacgctgctgcggtacggcggatagtcgatccggggctgggggccactcgactgccgggccgccgcctcgatctcctgactgatgtcggcctgggtgttcaccagggggacgctaggcgctcaccgcccccggaggcgatactcggcttccactcaacggaagggaccgcgatggccaggagcgtcaccggccgggcgctggacctgctcggcgcgttcgacgccgagcaccgcagcctcaccctcagcgacctggcgcggcgctccggcaccccgctgaccaccgcgcaccggctcgtcgccgagctgcgcacctggggcgcgctgtcccgggagccgaccggggagtacgtgatcgggcggcgggtctggcagctcggcctgctcgccccggtgcagagcgagctgcgcaccgcggccggcccgttcctgcacgacctgtacggcgccaccctggccaccgtgcacctggccgtccgggacgggctggaggtgctctacgtcgaccggctgggcgggcacgagtcggtgccggtgatcagcaagatcggctcgcggttgccgctgcacgcgaccggggtcggcaaggtgctgctggcgtacgcgccggacgacgtgctgggtgcggcgctgcagaagctgaccagggtgaccgcgtacaccgtgacccagccggcccgtctgctggaacaactgcgccgggtccgggccgacgggtacgccaccaccggcgaggagatgagcccgggcgcctgctcggtggcggtgccggtgcgcaacggcgacgacgtggtcgccgcgctcggcatggtggtgccggatctgcgccggcagctgccccggatggtgtcggcgttgcaggtcgcggcgcgcgggatcggacgcacgctgacttccgtccagtggaaataggcccttgcccgggagccgtccgccgctgaaggtggtgggcatgcgtacccaggtcgccatcatcggcgcgggcccggcgggcctgcttctctcccacctgctcgccctgggaggcatcgactccgtggtcctggagacccgctccgaggagtacgtcgcggcccggatccgggccggcatcctcgagcactccagcgtcgagctgctggaatcggtggggctcggcgctcggctgcgcgccgagggggacgagcaccgcgggatccacctgcagtggccgcacgaacggcaccatctcgacttcgtgaacctgaccggccggtcggtctgggtctacgggcagaccgaggtgcagaaggacctgatcgccgcccgccgcgcggccgggcaggagatccactacgaggtgaccgaggtccggctgcacgatgtggacgccgatcgccccttcgtgaccttttccgacaggtccggtcgcagcgttcggctggacgcggccgtcatcgccggctgcgacgggtcgttcgggccgagccgagccgccgtcccggccgcgaagacgttcgagaaggtctacccgtactcctggttgggcatcctcgccgacgtcgccccctccaccgacgagctgatctacgcctggcacccgcacgggttcgccctgcactcgatgcgctcggccacggtcagccggctctacctgcaggtgcccaccggcaccgacccggcctcctggtccgacgaccggatctgggacgagctggccacccggctcggccacgggcagaacggctggaaactccaccccggcccgatcaccgacaagagcgtgctgccgatgcgcagctacgtgcagaccccgatgcggtacggcaatctcttcctggccggcgacgccgcgcacatcgtcccgccgaccggcgccaaaggactgaacctcgcgatcgccgacgtcgcgctgctcggcagggcgctggtcgccctgctcggcgagcggaacccgacgctcgccgacgcgtactcggaggccgcgcagcggcgggtctggcggtgcacccacttctcctggtggatgaccacgatgctgcacacctcgggtgacgggttcgacgccgaactgcagctgtcgcagctgcgctgggtgacgtccagcgaggccggcgcgaccgggctcgcggagaactacgccgggctgccgatcacctactgaacccctatcgaggtagatatccgtggatccccagggagattcacggatacgctccgcctgcccggcacctactgtccgaagggtacggcgcgacgaacgggggtacatcggtggggtggctcggcgagtggctcggcgggctcccgccggtgttggtctacgcggtcgtcggcgccctggtcgccggcgaggccgcgatcatcgccgggatggtgctgccgtccgcgaccgcgctgatcgccaccgggctgctcgccaacgcgggcgtcgtcccggtcctgccagccctgctggtcgccatcggcgcggccctgctcggcggcaccgtcgcctaccggcgggcggcgcgcaccaccggtgccacgccgccggcccgcaccggcagacactgggcgcgggccgaacggctcttcgcccggtacggcggacgggcgatcttcctcggccagtgggtggtcggcgcgcggacgctgatgccacggctggccggccgcaacggcgtaccctatcggcgtttcgccctgtggcacacgccctccgcgatcctctgggcactctggatggtcggcgccagctatctcgccggcgccggataccaggccctcgccgcccgggccggccgggccgccggtgcgctggccgccctcaccctgatcatcgtcggtctgctgctggtcggccgctggctcggccgacacccgttcccggtccacgcccccggccgcctgtcgctgatccggcgcaccgtcgcccggtggcaccccgcggtgctcgccgcggtcagcctggccctgttcaccggcctcgccctggtgctgatcgaggtcatcccgccgatcgtccgtttcagcggcctggccgccgccgacgactcggtgaccacctgggcgcgcgggcagtggacgtcggacgggtactggttcgccctgtccaccgccggcaccctggcccccgaggtgccgctcaccttcgccgtcgtcgtcgcactgatccgcttcgcctggcgccgccgccccgacggcctgcgccacggcctcctgcccgccgtcatgtacctcgccgagctcccgtcccgagcccgcagcctgcgccggccccgcggtcctgagccgggcgcttctcagccgggcgcttctcagccgggcggatctcctcccggcgtttcccgaccgggcggtctccgggcgcgcggtctgctgcgcggctctttctgggcggccctgttcgaggcggtcggcccggtgctgccggccatcgtcctggcggtcgccctgtccctgctcctcgacccgggctggcgcaccgccggcaccatcgtcttcccctcccccaccgaattcgacggcggcggcctccccctggacaccgcccccagcatcctggccggaatggcggccggctccaccgcacagaccgccgccgccatcggcctgctcgcctggctgctcaccgacaacctgcgctggggctggcaggtcaccgtctggacggtcgcggccggcaccctgaccaccgccgccggctgctgggtctacctgggctggggccgcctcagcgaaaccgtcgcggcggtcgtcatcggcgcggcctgggccgccctcaacgccgccatctggaccgcccgctaccgatcagccgagcggccggtgctggacgaggccgaccaggttgccctcgctgtcccggatgaaggcctggacctcctcggtgccgaccggcccgagtgacccgtcccggtgcgtgaaaatgacgtgcggttcgctgtcgatcggcaccccggcggcccgcagccgcgccacggtcgcgtcgatgtcgtccaccaggaggtggtgcaacgccgacggtgctcccggttcgagcagcagccgcaccccgtccaggtcgaacaagaccagccccggcgggtcgaacgagggcaccggcggcgccccgagcaggtcacggtagaacgcggtggcccgcgccaggtcggtggcccgccgggcgatctgcactgctcgcactgttctccactttcccgtcgctccggtgcacacgaccaccccgccgcccggcggaccagtgcgtcaaggaccgttccatgctcgtaggatcggaacgacagcgcatccactgaacacctgagccggaggcatgaggctgccatggcataccggccgatgacgatggtcgaccttgctggacacctgcggcggcagcaggcggacaaggtccggtggaaacatctgtgggagttcctcgaggaataccggtgggaggctccggagagccggccggcactcttgcgcgacgagccggcgccgtgcggtgatcctcagtgggatgcgctgctcgccgcgctggccgagcaactcgccgcccaactggatctcgcaccaccggagtggtcccgacccagggttctggtaactccctggttcccttcttcgctgccgtccaagcgcatggaagcgctcgtctcggcgcccgcggccttccgcaagcacggcgtctatctgtccgcccgtgacctggaggcggcatgagcggcgacggtctgatgggccgcgccgaactcgaacgagccttcaccgctctgggtgaccgccttgttcgccgaggcgtcgtggcggatcttttcattgtgggcggcgcggcaatggcgctcgcctacgatgccgcccgtgtgacacgggacgttgatgcgacgttcgttccccatggagtggtcctggaagaggctcgcaccgtggctgaggtaatgggtctaccgccctggtggctcaacgaacaggcgagcgcatacgtctccgccaacacgacgccggcaagcgggaggtattcgaccatccaggcatcagggtcatggcggcctctgcggaacacgtattcgcgatgtgatgcccaggtggcggctgaacgagcagaatgcccgaagggatcatcgagagacaactggatgtcggcctagttcggctgaacgatgaccttgcccagggcgcgcccctcgcccacccgggccagtgcctcgggcgcttgctccagcggaaacgtgcggtcgatgtggacgtcgagctcgccgccggcgcacaggtcggccaccgggccgaaatggtgcggtccctgtttgacggcgagcacacccagccggcgaccggtgagccggccggcgaccgtgccggccgtcagcacgcgcagcagcgtcggcaccgagcggcgccggggaccggcacggggagttcctcgagcctgagcacggcgggcggcccgtaccggtcgtacaccactgctcgcatccgcacacgtcccacctcacggttggtagcacgcgcggacaagctttccgaccggaccggccacggccacctggttacggccgccgttcttggcctggtagagggcgtggtcggcgcgggccatcaactggtcgagggcgtcgccgtcggcgccgagagtggccacgccgacgctgatcgtcacgcggacccgtccaccgcgggtggtcaccggctcggcggcgacggcctcgcgggtccgctccatcgccgcgatatcggcgccgtcgcagtcgggccggatgatcgcgaactcttcaccgccgtaacggccgagcacgtcggagttccggatggtgtcctggacacgctgggcaacggcgcggatcacgtcgtcgccgacgccgtgaccgtacccgtcgttgatgttcttgaacttgtcgatgtcgatcatcgcggcgctgagcgggctccgcccgccaactggcaaaatcggcgcatgggtgctcccgagctggttctggtgctgcgctatcgcaaggcggtgacgtacggctttcacgcgctgctcggggcgctgggcgagcacgactcccccacccgctacgaggtccgcttcggcgagactccggagcagacggcccggcacattcgcgaggccggcgacacccgcgtcctcgtgctgtggtccttctattctcccgacgccgccgcgctcgccgaggaactcgagcagatccgggccctcgccgacggcccgcacgtcacgcacctcgccggtggggtgcacgccaccgccgagccggtgcagacgctcgatgccggttgggacgtggcggccgtcggtgagggtgaatcgaccctgatcagcctggtcgacgcgaagggcgacccggccggcatcaccggtctggcctaccgcgacaccgccgggaacctcgtgcggaccggcaaggcgaagcagcggccactcgacgacttccccggcttcgcgctgcggtgggacaggttcaacgccctggaaatcacccgcggatgtgtctacgcgtgccggttctgccagacgcccttcatgttctcggcgaggttccggcatcgcagcgtcgacaacgtgcggtggcacgtcgatcagatgcgggcgcgcgggctgcgggatgtccggttcatcacgccgaccgccctgtcgtacggcagccagaacgaggatccgaatctggccgcggtcgaggagttgctggccacctgccgggaggggatcgggccgcgcgggcgggtctatttcggctcgttcccgagtgagatccggcccgagcacgtcacccgggaaacgctgcggctggtcaagaagtactgcgacaacaacaacatcatcgtgggcgcgcagtccggatcggaccgggtgctggacgcggccaaacgcgggcacggggtggaggaggtgaagcgcgcggcccggctcggcatcgaggaggggttccggatcaacgtggacatgatcttcgggatgcccggggagagccgggacgacgtcgaggactcgctgcggctggcccgtgagctggccgacctgggggcccgcatccacgcgcacacgttcatgccgctgcccggcacgccgtggcgggacgcgccgcccggggatgtcgacccggccacgatccgggaggtggaccggctgtcgcggcggggcgcgctgtacgggcactggcagaaacagcgggatcacgcggcccggctggcggcggcggcgcaggcctatccgcggccggggcgcagccggacgatgctgacggtgcatgacatacgccaccaagattcgccgtgaggcaaccgtgatcggccggaacccgtctgggagatgtgagcccacgacgtttactggccgcgacggccctgctgctgctggccggctgcgatggatcggcccaggcgaaaccaccgcagacacccccgccgacggtgaccgccggccggtcggcgccgcccaccagggcacccgctccgaagccccggatcacctacccggccaccggtagccggaagttcgcggtcgcctcgggggaggccgcggccccggccggcgatcggaagggccggctgctccggtaccacgtgctcgtggaacgcgacatcaaaggcgtcaccgccagcgagttcgccaccgccgtcaccacgacgctgcgcgacccgcggagctggaccgccggcggccaatggcgtctgcagcgcgtcgggccggagcagaaggccgatttcgcggtacgcctcgtcacgccggccacccgcgacagactgtgcgagggcgccaccgacgggtacacctcatgccgtacccatgatgaggtggtcatcaatgtcgcccgctgggccaagggtgtgccgcactacggcgcgagcctcgccgtctaccgcgagtacgtgatcaatcacgaggtggggcatcgtctcggccaggctcacgagctgtgccccgggcggggccggccggctccggtgatgcagcagcagaccctcggcctgcacggctgcaccccgagcgcctggccgttcctgaacggggtccgcaaccgcggccggatcggggcctacgacgacccggtgccgccgcgcgacaggggactttcctgatgcaggggccgcgagccggggtgcccggctcgcggcccgcccctcaccgtcgtttcttgggcaggtcgaactggtcggcccggcggcagtccacgtggtcgccgaccgcgtccttgcccaggtcggcgagcgccttgcgggcccgggcccggcccaggttccaggcgtaccacgggtcgggtcgcgacaggtcctgggcgatccagctgagcgtgcaccgccggaccggatcgggcagtctggtcagtgccggggtggcgtcggcggacagggcccgcagataccaggcgtcgatcttgccggtctcggcgtagcgggtggcgttgcggctcgccgcgtacccctcggggtcgaggaccgcgaggccgagcagcatgagcacggcgagaccgacggtggcccgcgggatccaccggccctgccagcggatgccggccgcggcgaccatcacgaagatcgtgccgagcaggatctccagcgacatcacgaagatccgctcgccggtgaagctgtacaccttctggtacgcccacatacgggacagcgcggacgccacgatcaccacgctcagtccgcagatcaggccgagcaggacgcgcagcagcagccggtcgcgcgggtcgtcgcgtttcgcccagcgggccagggcggccagcaccaccagcgacagcagggtgaccgccaccagctgccagaagccgctgcgggcatactgcgcgtagctgagcccggcggtctccagcacgtgccggctcccgccgaacatcaccgtgaactgcaccgccacgaacccgccgaacagcagcaccagcgcacccgcggccggcgcccactcgaccagaccgaaccggccgtgaccgggtctgtccatgctggaggtgaccggcggcgccgacagggtgtagatgccggccaccgcgatcaggccaccgaccacggccaggaacacccagcggaacaccgacccgacgttgatctcgggaaccgccttgccgagcagcgtggagaacgccacgtccgccgacgacagcagcgcgccgaacaccagcagcaccaggatggtgagcaccgcggagaaaccgatgcgccgggcgatcccggggttgcggctcgcccgcaggtgacggcgcacccagggcagaccggagatggcggcgtacggcgttgccaccagaccgaagaggatcgaccgcacctggcggcccccgacgatcgccagcgtggcacacccgagcgcgccgagaatgctgaacgtcaccagccaccacgcgttgcggaacgccgggaccagcagcagggccagcgtcgccagcgcccagccggaccggatccaccgctcgtagacgggcagttcggcggagcgccggatcgcgccgacgatgccgagcgccagcaccaggaagccgaggaaccagccgatcccggaccggttcagcggcagcaggaacgcgaacccgagcgcgccggccagcaccccggcgggcaccgcgcggccccgggtggcggtgggtccgggccagtacttggcacggaacgtctgccacggggtcggcggcggttcgtagcgtccgaacggcccgtgcgggaacggctccgtccgcacgggaacgtcgaccggcaccggccagccggacgcgtgcgcggctccgacgggcatcggcgcgggcgcaggtcccggctagctagctagccgggccgggacggtcggcgacgactcccgggccggcaccggcggccggcgcggtccgttgcggggacgccggggcggcgaccgcgaccggtgtggacggctgcgccggcaccatcggcacgaacagtgcgtacccccgggtcccggacggaatctgcaccgggatcgcccaggccggtcccccgtccggccagaccatcgacggaatcgcctcggtcggcggcatgaccagaagttgaggcgccggcgtcggttccgccggatctcgttgctcaggtggcaggtcggccacagcaccctcctcgatgggtcggtccgcacaacataggggttcagcaccacagatatcaacgctggaacggaaccgttccgccctgacggcacgaatccgggaggtaatccgaggcaccagagatgtcgatggagtcaccgccaccgacagtcgggaggcggtggcgcagcgcacacccgggactcggatgacggtgagagcgctctatcgctgccggccgatacggaggtcggcttcgatggcggcggtggcggccagcagcggtggcaggagacgctcgcggatggtgtcgacggtggcgcgggcggcgtggacggagatgtcgagtgcaccggccgccgcgccggagcgatcgcggatcggggcggcgatggcacgcagcccctcctccagctcctggtcgacgaccgcgtgcccgtcggcgcggacccggcgcagctcggcgcgcagctcgccgggggtgcggatggtgcgcccggtgagcggcttgagctcggccccggacaggtaggtctccaggtccggttcgggcagcgcggcgagcagcacccggcccatcgacgtggcgtaggccgggaaccgggtgccgacgttgatcgacacccgcatgatgcggctggtcggcacccggctcacgtagacgatgtcgggtccgtccaggacggacagggaggacgactcgcggacctcgccgaccaggcgttccatgtgcggctcggcgacctcggggagggtcagtccacccaggaaggcgtagccgagttcgagcacccgcggggtcagcgagaacagccggccgtcggtgcgcacatagccgagatcggtcagggtgagcaggaatcggcgggccgcggcgcgagtgagtccacagtggcgggccacctcgctgagtgtcagctcgcggtgctccgcgtcaaatgcacggatgaccgccaggcctcgttccagggactggacgtagtacggttcccgcgtcatcggatgatcgacacaggtcgttgacgtgacacgagccacattctagcgttctccatgagaactttcgttcgttgtgcgcacacatctacggaggaacagatatgcggcggcgtttgctcgcgggcctggcactggcgctggtggccggcacggtcgcggcctgcggctcggacaaggactccagttcctccggcggatcgtccgggggtgtggacaccgtgaccgtgggcgtcatcccgatcgtcgacgtcgccccgatctacctgggccagtcgaagggcttcttcaagtcccgcaacatcgagctcaagctggaggccggccagggcggcgcggcgatcacgcccggtgtggtcagcggccagttccagttcggcttctccaacctgacctcgctgatgatcgcgcagaccaagaacctgccgatcaaggtggtcgcggccggcgtctcgtcgaccggtgtgcagggcaaggacttcggtgccgtggtggtcaagggcagcagcccgatcaagaccgccaaggacctggagggcagaaagatctcggtcaacaccctgaagaacatcggcgacacggtcacccgcgagtcggtgcgcaaggccggcggcgacccgagcaggctgcagttcgtcgagatgccgttcccgaacatgccggccgcgctggacggcggccagatcgacgccgcctgggtggtcgagccgcagctcaccacgatcaagcaggccggcggccgggagatcgcctcgacctacgtcgacgccgccccggacctgaccgtcgccgcgtacttcacctcgcagaacctgatcgcttccaagcccgacctggtgaagcgcttcaccgaggcgatcaacgagtcgctgacctacgccgacgcccacccggaccaggtgcgccagatcctcggcacctacaccaagatcgacgagaagatccgcgccgccgtggtcctgccgaagtggcccaccgagatcaacaaggcgtccgtgcagacgatcgccgacctcggtacccaggacggcatcttcagcaccgctccggacctgggcaagctcctgccgtgacgtccgcgcgccgtggcaacccggtcctgctcggcctcgccgggccggccgggttggtcctcatcgtcgagctgctgccccggctcggcctggtcaacgaccggttcctgccgccggccagccggatcgccggcgcgctcgccgacgaggtggccaccggggcgttctggcagtcgctgggcgacacgctgtacgcgtgggcggccggcctgctgatcgcggtggccgccggggtgctggccgggctgctgatcggctcggtgccggtgctgcgcgcgctgaccgcgtccacggtggagttcctgcggccgatcccgtcggtcgcgctgatcccgctcgcggtgctgctctacggcacccggctgggctccaccctgctgctggtctgctacgccgcgttctggcaggtgctggtgcaggtgctgtacggggtggccgacgtcgacccggtcgccgaggagaccgcgcgcagtttccggttctccgcgtggggccgggtgcggcacgtgctgtggccgaccgcgctgccctacgtgttcaccggcgtgcggctggccgcctcggtggccctggtcctggcgatcaccgccgagctggtgatcggcgcccccgggctgggcaaggagatcgccaccgcgcagaactccgacgcggtgcccaccatgtacgccctgatcgtggtcaccggcgtgctcggcgtgctgatcaatctactgacgcgcaccggcgagcgccgcctgctggcgtggcaccagtcggtgagaggcgaggcgggcgtctgatgggcgtactcaagaagtggtctttggccgtgatcctcccgattctgctcttcgccgggtggttctggctcagtgacgacagcaggagctactacgcgccgccgctgcggcagatcctccaggcgttcggcgacacctggaccctcgaccggctgcgcaccgacgtcgcccccagcctggtccggctgctcgccggcttcctgctggccgcggtgatcggggtcggtctcggcgtcgcgatcggcctgaaccgcaagctgcgggcggtgctggaaccggccctggagttcttccgggccgtcccgccgccggtcctggtcccggtgatcatgctgttcgccgggatcggcaacggcatgaaggtgatcgtgatcgtctccggctgtgtctggccgatcctgctcaacacggtcgagggggtgcgcgccaccgacagcgtcgtgctggacaccgcgcgcgcctacggcgtgaccggcccggcggggctcacccgggtgatcctgccgtcggcgtccccgcagatcgcggccggtctgcgccaggcgctgtcgatcgcgatcatcctgatggtgatcagcgagatgttcgcgtccagcaacggcctgggcttcaccatcgtgcagttccagcgcagtttcgcgatcccggagatgtggagcgggatcatcctgctcggcctgctcggcttcgcgttgtcgctgttgttccggctcgccgagcggcgggcgctgcggtggtacgaggggctgcgcgcggcgcggcgccgggccggttaggagggccagcatgctggaggtcaagggcctgcggaaggtctacaggtcgggcggccgggaggtggaggcgctgcgcgatctcaccttcaccgtcgagggcggtgacctggtctgcctggtcgggccgtccggctgcggcaagacgacgctgctgcgctgtgtctccggcctgctcacgccgaccgccggcgaggtccgggtgggcggccgggaggtggccgggccgccgccggggatggcggtggtcttccaggagtacggccgcagcctgttcccctggatgagcgtgcgggacaacgtcgagctgccactgcggcagaagggtgtcgcccgggcgcggcgccgggagctggtcgagtcgtcgctggacgcggtcggtttgggcgggaccgcgacggcgtatccgtggcagctgtccggtggcatgcagcagcgggtggcgatcgcgcgggcggtcgcctacgagccggagacgctgctgatggacgagccgttcgcggcggtcgacgcgcagacccgggccgatctggaggatctggtccggtcgctgtggcagcggctcggggtgacggtgctgttcgtgacccacgacatcgacgaggcggtgtacctggggcagcgcgtggtgatgctgtcgtcgtcgccgaccgtggtgcaggacgagctggtggtggacctgccgaccgaccgcgatcagctgcacacccgggccgatccgcggttcatcgagctgcgcgcccacgtgtacgagcagatccagctggcgaagaagaacgcctgacgccggggtccggggcatgctcccggaccccggcgccgattcagcggccgaccgccgcgcgaatcacgtcacgggcggtgtccgcggtggccgcgctcttcttgctgagcgcggaaaccgcggtcgggtccggctgcggcaccggctggcactgcttgtcggaccggttgccgtgcacccgcgacggcagcgcaccggtcgccaggtaggcggcgacggtgtcgtcggtgcaggccaccccgctgagcgagccggcgtgcgtggtgccgccgacgccctcgatcagcaccgagcgcgggaagagcttacgcacctgcagggctccggagtacggcgtggcggcgtcgtcggtctcgctgatcagcaggaccgatggagccttcgcaccgttgatccgcaccggggtgcccggcttggcgccccaggtggtgcagggcgcgttgtaccaggcgttgttccaggtgatgaacgggtaccgggagtagatcgtccagttgtccttctgccactttgaccagttggtcggccacttcacgtcgctgcactgggtggccaggtacatcgcgtagttgttgtcggcgcccggcgcgcccggctcgctgtagctggccagcagcaggctcgggtccttgtcgttgacccaggccgcgaacgcgtcggcgacgtcccgccagccgtagacgtagtagccggccgagacgaagatgtcgttccactcgtccgggccgatcttgccggccgccggcgccttgcggagctgttgcaggaccgagtagtacttcttcttcaccgccttgccggtgacgcccaggtggtagaccgcgtcgtacttggcgatccaggtgaagtagacgtccatgttcttgtcgaactggatgtcctggtcgaggttggcgtcgtaccagacgccccgcgggtcgaccacaccgtcgaagacggcccggcgcacccggtccgggtgcagggtcgcgtagacctggcccaggtacgtcccgtacgagaagccgtagtagttgatctggcgctggcccagcgccttgcgcaggctctccatgtcggccaccgagtcggtggtcttgacgtggtcgagcagcgcgccgccggcccggtcacacgccttcgcgtagcccgcggccttcttcagccaggtcttctccagcgaccgggtgaccggcacgtagtacggccggttgtagccggcgtagttcacgtcgcaggacagggccggcacgctggagccgacgccgcgcgggtcgaagccgatccagtcgtagtagtcgccggcgtggtccggcaccgactcgccgatcaccggcagaccgagaccactgccgccggggccacccgggttggtcagcatgacgccctggtactgcgcgtcggccgacttgtggttgatccgggacaccgcaatcttgatcttggtgccgttcggtttcgcgtagtccagcggaacggtgagaaagccgcactgggcgttgcgcgccttgaggctcgcccgggtgcaggtgccccagtcgatcggcggcggggtgtagccgtcgtcgtggccgctgtgcgccacggcggcgaccgggatcgtgccggcgccgacgagcaggccgaccgaggcggcgacggtggccgccaggatttttcgcatcccttgccttccgttgtcgaaatcgtcctgccggcgatggttcgcccggacgatctccgcagactagccattcaccgatggagatgcgttccaccgatcggctgaccgcgctctccaccgcacgctcgggagaccgggcgaggctcggcgacccgcgcggcggcgatgctcccggtgtcgatgcggcaacgggatgggggcgccgggatgcgcaaggtcgttcggttcatgggttgctacgtggcactcagcttctcgacgctgggcgcgatcgtcgccctgcgcgacacgcactacgtcaccgacgcggtcggggtgcgggcctcgctcgtcgcgctggcgtcgctgatctcgctccacctgtcggtgcgggcgctgcgcggcagccgcggggcgctgctgcggctgcggatcgtcacggcgatcatgctggtcgcgatcgtggtgatcgcggcgctgcccgggatgttcccgctctggttcaggctggagcaggtggcctgcggactgctgctgctcaccccggtcatccggatcaaccggaagccggccctggcctgagatcgaggatccggaaacggaaggccccccggcgggggccttccgttttgttgctcgggtgcgtaatactcggtagcgagcattcacaccacgaggagcgagatggcgaagcggcgcaaggtgggcaacctcctcgggttgcacatcctggcgacgctgagcatcgagccgatgcacccctacgagatggccgcccggctcaaggagttcggcaaggatcaggacatcaagatccaatggggatcgctctacacggtcgtgcagaacctggagaagcacggcttcatcgaggcggcggagacggtccgggacggccgtcggcccgagcgcacggtgtatcggctgaccgggaacggccgcgccgagctgaccgactggatgcgcgagctggtcggcactcccgcacgggagtttccgaagctgcaggcggcgctctcggtgctcggcgtgctcccgccggacgaggtgatcacgctgctcgagcagcgcctcgccaccctcgcgatggagaacgatcggatgcgggccgacctcgacggcaaccgcgcggtggtcccccggctgttcctggtcgaggcggagtatcggatggcgatccgggacgccgaggtcacctggctgaccgggctgctgaccgagatgcgcgagggcaccatggccggtctcgccgcctggcggcggatccatcggaccggcgagatgcccactgatctctcggagttcatgacgatcaccgagacgtgagaaaagcggccccggccggtgcgggaacaccggccggggtcgtgccccatcaaccggccgcgggaacggcccggctcatccgaggcgtgtagcagcaacaaggataaccgggacacggcccgtggcgatctggagaaggatcaccatgagtgatgccgtgacggcacaggaactacgcaagagttatcccggcggggtgcgggccctcgacgggctcaccctcaccgtccgcgccggcgaggtgttcggcctgctcgggccgaacggcgccggcaagtccagcaccgtcaagatcctcaccacgctggcccggccggattccggcggcgcgaccgtggccgggcacgacgtgctgcgccaccccgaccgggtgcgccgcacgatcggcgtcgtcccgcagcgctccgcgctcgacccgatggcgaccggaaaggacaacctccggcttcaagggcgtctcttcggcgtacgcggtgggcagctcacccggcgcgtggacgagctcctggagcgcttcggtctgggcgaggccgccggccgggcggtccgcggctggtccggtggcatgcagcgccgcctcgacgtggccctggccctgatccaccggcccggcgtgctcttcctcgacgagccgaccaccgggctggacccggaggggcgcgccgagatgtggaccgagatcggccggctcgccgcggacgagtcgatcgccatcctgctcaccacgcactacctggacgaggccgaccggctggccgaccggctcgccatcgtcgacggcggccggatcgtggccgagggcaccccggagagtctgaagggggagttgcggggtgatgccgtacatctgcaattggcgctgccaccggatgagccgcaggcgcggcgggccatcgcgcacgtcgccggcctgcgcgacatcgccctggacgggcggacgctgagcgcgcgggccgacgacggcgcggcggcggtcccggcggccctggccgccctcgaatcggccgggatcggcgtcgcgacggtgaccgtcgcccgcccctcgctggacgacgtgtatctgcgccacgcgggacggaggtacgcggcatgacgaccctggtgacgcacacctggtggatgaccaaccggcggctgaaggtgctgatcaagcagccggcgttcgtggtgatcctgctgatccagccggccatctggctgttgctgttcggcaacctgttccggaaggtggtggagctgcccggcttcggcggcgggtcgtacctggactacatcgtgcccggtgtggtcgcgatgaccgcggtgtcgtcgaacatgtggtccgggatgggggtgctcgaggagatcgagcgcggcaccatgaaccggctgctgaccaccccggtcgcccgcggcgccatcatgaacgcgctggtcgtcgagcaggcgctgtccaccgcggtgcaggtggcggcgatcgtcctgctcgggctggccgccggggcgagctacccgggcggcgcggccggcctggtcgtgctgctggtcaccgcgctgctgctcgggacgatcttcagtgcgctctcgaacacggtcgggatgctggtccggcaacgcgagacgatcatcgggatcaacaccctgctgctgttgccgctcaccttcctgtcctcggcgttcatggcggcgacactgatgccgtcgtggatgcggcggatcgcggaattcaacccggtgaactggtgcctggcggccgcccgggcggcgatgcgggacacgcccgactggggggtggtgctcagccgcggcggatggctgctcgcgctggccgcggtgatgatcttcctgtccacgcggacgttccgggcgtaccagaaatcggtgtgatccagcggacatgacctcagggtcgtcgggcgggtcccgatggttgcggccgtccctggaccggaacggaaacgaggacccgcaccgatgacgagccccgcgcagcccgccggatggtacgccgaccccagtggtctgcccgcgacccgatggtgggacggccagcagtggaccgaccacctgcagcccgggccggcggtgctgccgccgaccgcggggctgggcggctactacccggcggccgcgccgtccgggccgctggtgccgggggcacacacggtcgcgccgcccgacccggaggcggccgcgatcttcgcgcactcggcggcgtcggccggggccgcgttcccggcggcgcggccggtggcaccgggaccggcgggtggcgctctaccggcgccgcccgccgaactcgtcgactacgccatcccgccggtcgactccgccgcgccgctcagcggcttcgggatgccggcgccggccggcgacccggagaaacggccggctgcccagcacgcgaccggcctgctgacgcatccgctgctgctgggcaccctggccgtcgtcgtcctggtcgccctgatcgtgctcaccgtgctgcgctgagcgcgccggtcgtggatcggacagcgagcaagggccgtcgcgcacgcatggaacacccgggcagcggggtacctgacgaccatcgacacgagcggccgcgtccgggtcgcgggagtccgaagtgaccgatcacggatagaacggcgtgggccgccggaccggcggctagcgtggtgatcgtcgctcgacgatcacccgcggcgcggccggcgtccggacggaggtcaccaccatggccgagcacgcggccgcgcaacgccggaactggctcgtcgccctcggcgcggcggtgatcctgctgatcctgctcgccctgacgctgtcgttctgcgatcggaacgggggcgccggcaccacggcggggccggcgacgacggccagcagcgagacgctgccaccggtgtccgggccggcctcgcggccggcgtcagcctcggcgtcgccgggcacgctgtcaccgaagaccgtgacgaccgccgacgatccgacgaccaagccctcgccgtcgcactcggcgtcgccgtcgcaccggcccagctccaagcccgaccggacgccggccggtggcgtcgacgccgggggcggcagcgggctcgacggccggcgcctggcactgctggtcggcggcgcgttcctgctgctcgcggcggtgatcaccggccggttcggcttcggccgcgctcgatgatccgcaaccgtcgggccgccgtcttctccgttctgctggcagtgctcggggccaccgtcaccgtgctcggcctgatcaccgacgacgcgctgcccgacccgccggccgtcaccccggcctgggaggacgtgccggcgccaccggcacccaccaggtcgaggacgcaccgctcgcaacccaccgcgctggacatcccggcgatcggtgtgcacaccccgatcaccccgatcgggctgcgcggtgacggcaccctggacgtgccgccgctgcgctccgacgccccggccggctggtacgacgggtcgcccaccccgggcgagcccggtcccgcggtcgtcgtcggccacgtcgacaccgcgcgggacggcgcggcggtcttctaccggttgcgcgagctcaagccgggcgacaccctcacgatccgacgcagcgaccggtcgaccgtgaccttcaccgtcgtcaaggtcgccagttatccgaagaaggcgttcccgagcgacgaggtgtacgggccgacgggcggcccggcgctgcgcctgatcacctgcgggggatcgttcgaccggagccgtcgcagctatcggagcaacatcgtcatctatgcggtcgaggccgcctgagcgccgctcgccggtaacgtgaaaccgattccggtaccggttccggcggtctgttcggttctcggttccggaacctgggcggcttgcccacattggatgccgtatgccttttccccgctcttgacatggaggtacgccgattgcttccgtgacctggatcattgcgatcttgtttccggaaggggtccctccgtatgtcgaccatccgccggcgcaccgcgctgcgccggaccaccgccggagcgttcgcgctcggcctggccctcacggccgtcacggcccaggcctcgccggccgccgcacattccacatccgccgtgcccaacctcggcccacacgtcaccgtcttcgacccgagccagccgatcgccgacatccaggccaccctggacgccgcgaacgccaagcaggtcgacaacgagatgggcaccgaccggtacgccttcctcttcaagccgggcacctatggcaccgccgagcacccgctgcaggtcaaggtcggttactacaccgagctggccggcctgggcgccaaccccggcgatgtcgtgatcaacggcaaggtcgaggtgtacaaccgctgcctggagaacggcggcacgagcaactgcctggccctggtcaacttctggcggaccgtgggcaacctgaccgtcaacatcaacggggcgggccaggacggctgccggggcacggccaacttctgggccgtctcccaggccgtctccctgcggcgcacccagttcaccggcggcaccctgtcgctgatggactactgcaccgccggcccgcagtacgcctccggtggtttcatcgccgacaccagggcggagaccatcgtcaacgggtcgcagcagcagtggctgacccgcaacagccaggtcggcaactggtccaacggcgtgtggaaccaggtcttctccggcgtcgtcggcgcccccgacgagtcggcgtttccgaacccgccgtacaccacgctggccaccaccccggtcagcaaggagaagccgtacctgttcgtcgacgcgcacggcaggtggcaggtgcaggtgcccgccacgcagaagaacacctccggcgtcacctgggcctcggccgggcgcaccctgccgctcagcgacttctacatcgccaagccgggcgactcggtcgccaagatcaacctggccctggccctgggcaagaacctgctgttcaccccgggcgtctacgacatcgaccgcaccatcgacgtgtggcggccgaacaccgtggtgctcggcctcggccacgccaccctgaccgcggtcaagggcgccaccccggtgcaggtcgaggacgtccccggcgtcaccgtcgccgggctcaccatcgacgccggcaccgtcaggtcgtccgcgctgctgcgcgtcggccgcggccacggcttcggcttcacctcggcgaacaatccgaccagcctgcaggacgtgtacttccgggtcggcggcccgcacgtcggcaaggccggcaccgcgctcgaggtgaacagcgaccacgtgctgatcgaccacacctgggtgtggcgcgccgaccacggcgtcgagggcttcaccggcggcgacaccgagcggtggaacaccaacatcggcacctacggcgcggtgatcaacgggaacgacgtgaccgcgaccggcctgttcgtcgagcacttccagaagtacaacaccgtgtggaacggcaacggcggcaccaccgtgctctaccagaacgagctgccgtacgacccgccgacccaggcggactggatgaacggcccggtccagggctacgccggttacaagatcggcaaccgggtcaagacccaccacctgtacggcgcgggcgtgtacgtgttcaatcagaacaaccccacgatccacaccgcgaacgggttcgaggcgccgcagaccccgggcgtccacctgcaccacatcatgacggtgaacctgagcgccggcgtgatcgaccatgtcgtcaacggcgtgggtgcggcggcggacaccacgaaggtcggcgtgccggtctacgtgaacgactacccggccgctccgtaagaaccatgcggtggtcacgctccgccggagcgtggccaccgcttgcccttgcctgtgtacgcggtgagccgggccctttcgtggacgagtgggcaccctgcgcgtggctacgcatggtgatgtgcgaagctgcgcgctaccacatgcaccctcatctcccgcccggaggcccgatatggcagcatttttctcccttgtggccggggtcgtggtcggcctgatagctggatggttcatccgtggacgctcgctcggggccgcgacggctcccgcggtggtcacgccggctgccgccaccgagaccgcgcccaccacctcaccctccgtttcgccgaccgccgtttccccggcctccgtttcgccggcctccctttcgtcgagctccgtttcgtcgaccgccgagaccgctgtcatcgagcccgccgccgaggccggcaccgagcgcttcgacgtggccgagacggctgtcgtcgagccggtcgaggctgaggcggaggtcgccgagccgggtgccgagaccgtcgtgatcgaggccgtcgtcgtcgagccggtcgctgtcgaggagccggctgccgcggctgagccggccgcggtcgacgagccgatcgtcgccgctgagctagctagctagcccgtcgccgccgctgaaccggtcgtggccgacgagccggtcgccaccgacgagccgatctccgcggaggagttcatcgacgagccgatcgcggaggaggccgaggaggcgtccccgatcatcgagccgtccgaggacccggcgccgatcgacgcgccggccccgatcgaggacaccatcggcgttccggccccggttcaccagccggacgacctgaccaggattcccggcatcggcccgaaggtcgccatggcgctcgcggcggccgggatcacgacgtacgccaagctcgccgattctgatgtgaccgatctgaagaaggcggtcaacgccgccggcatgcgcggctccgccagcctggccacctgggccgacaaggcccgcgagctgaccgtcgccggctgaaccctccggtccggcctccccgggaggccggaccgcggctgtcgcccaggtcaccaaaacttgatgcggcagaagtagcaactcgggagtgaccccgccgatgtgaggggccgtccggttgccagcacgtttctaggagctcccgatggccgcgatcaccgctaccgccaccgcgtcttcgacttcgtccgaccgccaggccgcgtggacgcgcctgcagacgtaccgccgccagctcgccgccgacctgatcccggtgcaggcgagcccgcagaccatcaacaccgaccgggccgccgtcgccgccgccgaggccgaggtcgcccggatcgagggcgtccgcacggtgaccgccggcaaggtcgcctccaccgccgtgcaggcggagagcgccgcgatcgcgagcgaacggtcgtccgccgacagccagcggtcgtccgcggcggtcgcgtcgtccgcgccggttccgtcacgatcgtccgcggccgccccggcgtccgcgccggccgggtcccgggcgtccgcggacacggcggccgtgaccggcctgccgtacggccgcagcctcgacgtcacggtctgacgcggctgacggatctccgacacaccggatccggtgaaatcggcacaccgcgcccgtcccgccccgcacgccgtccaagaccacatcggacctgctagatcgccgcacaccggccggaatccgacaaagatcaacaaccgaaggtcatcgaccgcggacagttcgtaatcttccaggggttccggctcggctcttcccgtcgcaccatggaccaagggtgatgcgatgagcgggcgacgtctggcggtcgtggtgacggtcgaacaccacgacgatcccgtcctgcgccggtattcggtgccgtcagcggacgtgcggggtctcgccgccgtgctggccgatcccggtctcggcggcttcgacgtggagttcctgcaggacccggagacgtgggacgtctatcagcgcctgcaggccgtcgccgacaaccgcacccccgacgactgtctgctcgtctacttccgcggcatcttgctgtccggcccgggcggcggcctgtacctggccacccccgacacggtgatgcagcgtcccgccgacaccgccgtcgacgtgacccgcctggacgcgctgatccaccgcagtcacgccggtcaggtcgtgatcatcctggacggccgcaccggcggcccggtcgacgccggcgcctacttcccggccgcccacgccgccgacaaccgcagccgcgtcctgctcaccgccgacgcccgccccgaaccccccactttcgccggcctgctcgccgacggcctccgcggcggcgccgccgaccgcaaccgcgacggctacaccggcatcgacgaggtcatcgaccacctgcgcgaacgcgacccgtccgtccgccactggacgttcggcaccggtcgccagccctacctgtcgaaggtccgcaagccgggcagcgaccagatggccctgatcgccgaactggccgcggcggccgccggccccgacctcccgcaggccgcccaggcccgcaccaccctgtcccgcctcgccaccggcagcgaccgggtcgccgccgccgccaccgccgccctgcgccgcacctccctgcgagtccccgacccccagatcactttcggccagacgcttcccggcggtcccgcgcagaccgcccgggtcccgctgaccgccccgcccctggtggccacctccaccgtgaccaccaccggcgacggcctgcaagcggtcctggacggctcgcacctccaggtcacctggcgccccggccggtcctccctgaccggctccgtcaccatcgacggccccaccggcgtcgcccacctgtccgtgaccggcgaggtcaccccggagacctcggccctcccgaaaccgggcaccgcccctcagcccggacccgccctacccggcgctgcccctcaccccggcgccacttcccagcccggcgccacttcccagcccggcgccgcctcccagcccggcgccgcctcccagcccggcgccgcctcccagcccggcgccgcctcccagcccggcgccgcctcccagcccggcgccgcccttcaccccggcgctgtctctcatcccggcgccaccgctgaatccggcagcggggctcaatccggcgccgctgctcgatccggtcaatccgatgccaccgggcagggtggcaccgccctcgaaccgacgctgcctgcaccaccgcctcgctgggccggcggcaacggcgtacggcccacgtccggggccccggcgggccagccgccgttcagcgctccggtcgacccctggcctgacgcccccacctcgacgaccccgccccggcccggccggcggatccgtggccgaccgcacccgcctggctgcccgacgccagccctcaccaccgggtcgtcggcccgccctccgcacccggctcccacgaccaggtcaccagcccgctccccacttccggtgccccggatcagaacaccgaccgcgccccggcctccggcgcgcatgaccagacgacgagtgccctgacctcgccgccggccgcccatccgcagtcccgtccgcagatttcgcagggcccgtggtccggcgccccgagtcgccccgccgccccatggtccaccggcaccaccgaagacccgtcccacccgagcggcacgtggtgggcgcagtcccccggcgccggtcagcagccggaacgcacctccccgaccgtccccaccacccggccctcggcccagcccccttcgcagcgtcgtcccgaccacgacgccacaccgacccgcactcccgagccggccagccccctttcagcgtccgcgccctccccggccgccactcccccggccgaaatccacccggctggaatccacccggccgaaatctggcccggttcccctgccgagccgtccacccagacggagagccacgtcccatggccgggctccctcaccgccatgcaggccgacaccaccccggcacctgtcgccgacgctctcccctcaacgcttgaagccccgatccacccgcccggaccttccacctctcgccccgagtccccggctccttctcctgctcccgccccggttcccggtcccactccttcttctgttcctgctcccgtctggtccgatgtcacgcccgcctggtccgacgccgcctcgaccagccccagcgactccggtgtggatcaggtcgcccctctgacagatcccgttacgccgaaccatccggcgcccgaggagtccggcccaccccaggccgaagacgacgtgatcgaccaccgaaccgagtcgcctgccgattccagcgcccgcgaagccacacccccgagcgatccggaagcgctccgcctcagctccggcgccgaaacacaggcatggcccccggatccagccgccgacccggatccggtcgacaacccagctgaggttgacagcccgagcgcgcctgacagccccgccgggctcgacagccgcgccgcggttgacagccgcgccgcggttgacagccccgccgcggttgacagccccgccgcggttgacagccccgccgcggttgacgaccggagcaccccacgcgcagcggacatcgcggatacgccgagcaccccgcccgccccggccgagcagcacaccaccggtaaccgatccgccgccgtagccgcggccgcagccggcggtttcgtaggcgcttggctgaacacacagtcctcccccagcgatccccccgtccaggagcagccgatcgcgccggaccagaacccggggacgctgccccacagccgccaagaacaaccagcatcgaagggcgccgcaccagcgacacccccaacagccaacggcgacaccccggcggcccccgacccggtagtacctgaccccgcaacaccgggatcaccggtgacaccgacgttgtcgcctgccggcccctggcccggcgaccagccctccggccgcggcgcgttctacgcgcagcagcccggtttcggctggcagcaggcccccgccaacccctccgattccgccgctccccccgaatccgtcggccccgccgactccgccgactccgccacccccgccgaacactggacgaccgctgccggccaggcccagcagtcctccgatcctgccggcccgtggccgggcacctccgatcccgccggcccatggccgggcaccgccgttcccggccagtcctggccgtcccgcggcaccccgcatgagcagagcgaccgcacaaccgtctcctgggaggcgggttccgccgcagccgcagccggtggctggccccgatccaccgatccggcgaccgacccggcagtcccccaccggccagagtccccggtcccgactggcccacagtggccgggtcaagccgccgcggcagatcaagccaccccaccggaaccgcccacctggcccccacccccacatccctctgcagcaccgtcgaccgccccagcgagtggcgtcggcccgggcggatcctcgtcgcgcgtaagctggatcggcccgaacgactggccctcgacagccgacacccccggccatggaccgaccggtgctcccggccatggacccatcggtgctcccggccccggacgagccggcattcccggcgccgcaacagccggcgccgcaggtcccggacaggccggcattcccggtgcgggaattgccggcgccgcaggtcccggacaggccggcattcccggtgcgggaattgccggcgccgcaggtcccggacaggccggcattcccggtgcgggaattgccggcgccgctggtcgcggaccggccggccccggctccccgccggcacccccttccggaacaggtccggctgatgctcccggagtctccggcccccacagcggctcggagaccacggcctggggtggcgtccagtccccgagcggatggcagcaggcgcagaccgccgcccccgccaatccggcatggccgacctcgcccgccgggtggccggccgctcccggatggcagcagcccggcgtagcgtcgcccgcggcgggtggcgatccggcgtacgccaataatcctccgcaggagaagcggcgcctgcgcgtcgcggggatccttgttcttgctctgcttctcgcggccggtgcgtatctcggcatccggtacgccgcgggccgcggtcgggagcaggccgccccgccgccgacggtggctcagacgctgaccggcacgccgccgtcggggcaggcgaccggaccggccacgacgaccccggcgccggcgagtctcggcaccccggtcgtgctgaacacgatcaagggggtcggccgggagccggagggtgtcgtcgtctcgtcggacagcaagacgctgttcgtcgcggatcagggcgccaagcaggttttcgtcgtcgatgccgcgagtgggaaggcgcagccggtcgacgtaccgaacacgccgcgtttcctgaccctgtcgaaggacggtgcgaagctctacgtctcgatgttcgagaacgatttcagcgccaacgggctcgcggtgatcgacacggcgaagcgcagcgtgatcacgtcggtgaagacggggccacggccgttccagccggctgtcgccgcggacgggcgggtctggctgccgatccacaacggggcccgggtggagatctacgacgggacgacgctggcccggttgtcgcagatcagcgtgccgccgaatccgcactggatcgctttcacgccggacgggtcgcgcgcgttcacctcggatcacgagtcgagccgggtgtcggtggtcgacacggcgtcgttggcggtgctgaacaccatcacggtcggccggtcgccgcacagcctggcggtcaccccggacggcggcaccgtggtggtcaccaactatgacgtcgacaccgtggagacctatgacacgaggacgctgaagctgactcagcgttatcaggtggggaaactgccgcaggcggtgctggtgtcggcggacggtgcgcacgcctacgtggtgaacgagggctcggacaccctgtcggtgctggatctccccgcgcggaaggtggccgccacgatcccggtcggggacagcccgcgggtggtgggtctgtcgccggacggcctgcggctgtacgtgaccgcggggcgggacggtgcgatcacggtgctgaaggcggccgacggctgaccggtaatctcgccgggtgcgcctgcacggaaacgatacttttggctacgctcgaccgcagaaagccctggtagggtcgccgcatgccaacggattccggcgtcgatcgggcacgcctcagcaagctcgccgagcgcgagcgggccgctttcgccgagcggcatccgcggtccgcggcggcttacgggcgggccgaccacctgttcggccgcgtcccgatgacctggatgaacaagtccgcggccggcttcccggtctatctcaagaccgcgcggggcaaccggctgaccgacgtcgacggcaacgatttcctcgacttctgcctgggtgacaccggggcgatggccggccactcgccggccccggtggtcgccgcggtcacccggcggctgggcgagttgggcggcgccacgacgatgctgccgaccgaggacgccgccgccgtcggcgccgagctggcctcccggttcggcctgccgttctggagcttcgcgctgaccgcgaccgacgcgaaccggtgggcgatccggttgctgcgcgccgtcaccggccggtccaagatcctggtcaacagctactgctaccacgggtcggtcgacgagtcgctgatcgtcgtcggccccgacgggcgtggccgcagccgcgagggcaacgtcggcgcgccggtcgacgtgaccgagaccagccgggtcgccgagttcaacgacctggccggcctggagcgcgagctggcgcacggcgatgtcgcggcggtgctgatggagcccgcgctgaccaacatcggcatcgtgctgcccgagccgggctatctggccggggtccgcgagctgacccgccgatacgggacctatctggtcaacgacgagacgcacaccttctcggccgggccgggcggcgcgacccgggcctgggatctcgcgcccgacgtgctgaccatcggcaaggcgatcgggggcggcgtgccggtcggcgcctacggtctgtcggccgagctggccgacgcgcttctcggtcgcgccgacctcgacctggtcgacatgggcggggtcggcggcaccctggccggcaatccggtgtcgatggcggccacccgcgccacgctggaggaggtactgaccgagggcgctttcgccaccatgaccgccacggcgaccgccttcgccgacggcgttcagaaaatcgtctctgcgcaccgtctgccctggtcggtgagccgtctcggcgcccgggtggaatatcggttcgccgacccggcaccgcgcaccggcaccgagtcggcggccggcgcggatgccgagctggaggacttcctgcacgtctatctggcgaaccgcggcattctgctgaccccgttccacaatatggcgctgatgtgcccggagaccacgctggacgacgtcagccgccaccatgagatcttcgacgcggcgctctccgcgctcaccgcttcctgagcgctacggcgccgggcgtggtgggcggaaggtgaaggcgtacatgccgcgccggccggccgcgaacaggtccagggagtcgccgccccaggcgcattcgtgcagcgcgccgtccacccgcatcgccgcgaccggctgcaggtcgccggtcagcgggcggatccgcagttcaccgtcctggctggtggtggcgagccagctcccgtcggccgaaacggcgccgtgggtcaccgcggtctcggcgaatgcggcgcacccggtgcggcgcagcgtgcgtacatcgaagcaggcgacgccggaggcgtcgatcaccgtgatccggtcccggaccacgtggatcgcccggacctcggcacgacgcgaggggagcagcggccgcagccggttcttccggcactgccagacggcgagttcgccgccggctccggcgaggatgagccggtgaccgggcaggaaggcggcggcccggatcggactgtcgcaggtccggtgcagcggttcaccgccggcgaccgaccggacggtgactgcgccctggtcgtcccaccacgcgagcaggtcctggtccggggccgcggcgcagccgagcgcaccgggaagttcctcgacctcccatccgtcggccggcgaagaggagggttcgcggagcaggatcgtccgggatggcgacgccgccgcgatccacgatccgcaagggccgaccacgcaccgccggatcggctcctctcccgcccacagcacggcgccgccgcctccgccgatctcccacctgcgcaccacaccgtcgcggccgccgctgatcagcgatgtcccggacggtgccaccgcacagctgtccacccagtccaccggtccgccgacggtctcctggccgagccgcggaagatcccacacccggacggttccgtcactgccggtggtcatcagcgtgcgccggtcgggcccgatcacgcacccggtcacccatcccggatgggctcgcaccacggcgacctgcgccccgtaccggtcaatcatccggatcgtgccgtcctcgccgccggagatgatccggtcgccgaaggcgacgatcgtgctcacacacccctgatgtccacggacggtgaccgtctcgccgccaccgcggatcggctggatccggatcgtcccgtccacgccgccgagcgccacccaggacggcccggccgccagcccggcgaccaggtcctttcccgccatgaccaggactttccggcgtccgctgcgcagatcgtggccgaccaccgcgccttcgtcactggccgtcagcacccggtcgtcgtcgtagaacgtgcagccgaccagccgttcgccgccccgatggccgagaatccgccagttcccggccacatcgaggacgatcagctcccccgcggcgctcaccgccgcgatccggtggctggccggggccgccgcgcagcccaggatctcgccggacgtcgtccacagggtccgctcctgccggcggtccacgtcccacagccgcagcgtgccgtcggcacccgcggagatcagtgacgctccgtcatatgtcgcggcgagcgccttgatcgccccggggtgcccggtcaaccgggcgagcacgtcaccggacgccggatcgtgcagggtgatcacgccgctggcgccgccggtcgcgatccagccggtggcgaccgcgacggcgtcgagccagccggggccaccgccgatcacccgggtcaggctgtccggtccgacgtcgggcagcggccagcgcgcggtgagtccggcccggccccgctgtgcggcggcaaattcggtcacgccggcagcgagttcgggcgctccggagagccgggcgagcagcacgtcggccagtgcgtccgcgggctcgatcggtgcgaagagtgaggcgccacgggagagccgggcacgcagcgcaccggcgcgcggatccggcacccgatccagatcggccaccgcggccgcgacaccgagcatcgggatctgccgggccagccgccgcaggtcggtcacggtggcgaacaactcgtcccaccaaccggcttcccgcaggtgaaaggcgagatgccgccacagatggcgctcggtggcgggcagcgtccaccacggcccgccgctgcgcggccgggccatctccagcaggcggcggttcacctgcgcgatctccgggtcgaggagccgattgcggaggtacgcccggagcacccccgccacgcgcagcccgtccgcggtcggtttcaccaggcccagccgggcgtacgtggcgcgcaacccggccgcttcaccggcgttgagctcccccgtcccggcccagagcagatcggtcatcgcgtccgggatcggctcggccccgggaaagatcccgagctccagcaggcgccgccgatccgactcggtcagcagctccagggctgcctccgcggtcccctccacagcgcgttcccgctcgccgggcacggcgaggtcgagcgccacccatccgtacgcgcccagttgatcgatcagctggtgcggtgccacccggtgccgcagcacgccgttgaccagactgatcagcaacggccaccgtccggtcagggcgagcagcgccgtcaggtccggcagcgccaaccctggcaggtcccgggtgagcagcgcggtcgcctcgtcgtgccccatcccgccgacctcgatccggggcagatcctcgggcagcgccccggccacccgggtggtgatcagccggcggcagcccggcccgtccaggaacggttcgagctgctccgcggtccacacgtcgtcgatgaccagcagcaccggcggccggtgcgcgagcgcggcggcgagccgcacccccgcctgagccggggtgaccaccccgggtcgttccccggtgagctgctcgaccaggtcgcccaccagcgcggcgagcgccgcaccggtccgctgctggccgaccgtggcccagagcagcccgcccgggaaccggtcgcgcaggccgggcaagcggacgacctgctcggccagcgtcgtcttgccgatcccgccgatgccgtgcagcgccacgtcaccggccagcagcagctcccgcagccgggtctgcagccggccgcgttccaccagctcgtcgccggggccgccggccatccacggcgccgggcgcggctgcggcaccgcggccggcccggaaccctccaccggccggcgcaggcgcccgagcactccgccggtcgtgcccgtccaccgccgccaccctgtgccgtccgtcacgctgggaccaacggcgcggagacgggcaggtcaccgctatttctcgaccagattccgcagggcgccgagcgccgtgtggtcactgaccttggcgtagatcttcttgtccttgccgacgaacacggagaagggacacgccgtctcggtgccttcgagcttcttgtcgagcagcagccggtgcgtggccacctcgtagacccgcagccgccagctcgcgtggtacagcgtgaccgtctccggatccgggtcggtgtacttgcaggtgcggatcttcttgccctcggtggtccgatccatgcaggcggccatctgcaccttgcccgggccgcgtgcggcccaggtgttctcgtcgctcttggcggtgccctcctcctgcaggtagaagaccgggtcctgcgagcgcacgtcgtccgggccggtcttgaccagcagcaccaccgggtgcggggccttgcccgcccgcttcggggcgtccgggaagtagacgttggcgtcgcagacctggtccaggtcgtagatgtccttggcggccgtgacgctgggctgcggctcggtcgacgtggcggacggcgtcgcgaacgggttcccggacgggtcgtcggtcgggaaggcgaagccggacggcagcgtgaacgggtagtcgtcgccggcgccgccgtgcgatctgtcgccggaatggctcagcgcgtagatgctgccaccgcagagcaggacgatggcggcgatcaccgaggtgatgacggcggccaggacgccgccgcggcgccggctgcccggggaggccggcaggggcggccagggctgccccgggaacacaccggcgggatagccgggatagccggctggctgggcgccgggatagcccgggggttgcgcgccgggataacccgggggttgcgcgccgggataacccgggggttgcgcgccgggatgacccggcggtgaagtcgggggatggcccggcagtgcggaggcgcccggcgcgggatagttgccaggtgccgggaaaccggtgggggcctgcgaaaacggagggggtggctgaggaaatggctgatgcggtggcgtccacggctgcggcggtggctccgcgccctcggccgggcgggcccactcggagaccggctccgccggcggggtgtgcggctgcggaggctctcccggagcggccggccggacaggcggctcgaccggcgcggcggtcgggtcggtgggcgggccggcgggcggcggcgcggtcgggtcggtgggctggtgcgatgtgggatccggcgcgctgttgtcgctgcctggtgtttcccccgtgccggtcacgtcggtgtcctcccctgtgcggtgcgggcccaatgtatcgaagcctgtctcatcaggtgagcccgggctcagacccggtcgacggtgcgctcctggagatacccgagatcaggttcccagccgaggcccggggtggccgggacggtgacgaatccggagtcgcagaccaccggctcggtggtgatgtcccgggcgtaatacttgtccgacccggacacgtcggagggcagcgtgaaaccgggcagcgagctgagcgcgacgttcgcggcccggccgatgccgaattcgtgcatgccgccgcaccacaccggtacgccctcggcccgggccaggtcgtgcgcgcggacggcggcggtcagcccgcccatccgggacaccttgatgttgaggatccggcccgcccccagccgcagcgcggtgaccaggtcggccacctcctcgaccgattcgtcgaggcagatcggggtctgcagggtctcctgcagagcagcgtgcgcgaccaggtcacgcggggcgtacggctgttcgatcatcgtcaggcccgcgctgtccaggctgcggaagacgccggtctccgccgcggggtaggccccgttcgcgtccacgtgcagcgggatgccggggaaggccgcacggaccgcgcgcaccggttcgacgtcccagccgggggcgatcttcagcttgacccgctggtaaccctcggtcacccgcgccgacacctgttccagcagctcgtcgatggtcgattcgatgcccagcgagacgccggcggccacccggtcccgggtcccgccgagggccgcgctcagggcggtcccctgccgggccgaccacagcgcccaggccgcgacgtcgaagccggcgcgcgcgaagtgattgccgcggaccttcgccagcacggccgcgagatccgccgggtgatcccacccggtcgccagggtcagtggcttcaggtgatcgcgggccaccgcccagcagctctccacggtctccgccgaatagaacgggccgctcggcgaggcgatctcgccccagccggtggcccccgactcgtcggtgagcgcgaccaggatgtgctccagttcgcgcttcgcgtgcgagctggtccggaaacggtgcaccaggggcaggcgcacccggcgcagtgcgacgtgctggatgcggatcatgtctcctccacgtggaggtcgagctcggcggcgagcgcgtcccgctcccgcagacgccggccggcgcccttcgagctggcgatggtcagggtcgcgagcaggtgcagcgcgagcaccgtcgaggtcggcgagttgacgtatgaggcgctgcccgtgccgaccacgatccgggcggtggcgaggccggccaggggcgcgtcctcggcgtcggtgatcagcaccaggtcgccgccgtgccggacgtaggcggtggccacctcgaccgtctcccgccggtaccgttccagcgacaccgcgatcagcaggtcaccctgccggatgtcgctgagcacgtcgagcgggcgcagcgccgccccgtccaccagatgcaccccggacagcccggcgctcaggtcggaggcgagcagcgacgcgtagctgagcgacttgccgttcccgaccaggaagcgacgccgcgcggagacgatcagcgccgcggcccgttcgatcgcatcatgctcggcggcccactgcagcgcccgatcgaattcggcccgctgctgttccagcacccgctgcttgagcacctgcgccgaccgtcgctgaacgttacggtcgaagcgctccgcgggcgtgcctctcgaagtcacgccccatcctcggttgcgaacaggtacgccacccgcccggggtcaccatccggccggaccacgtccaccaggcgcccaccctcagcaaaccgcgtcaccagctcacgccgcagccaaccccgatccgccggatcaggcgcggcaacccgctcccccgccgccacgacgatccgcccatcccccggccctgcccggccccggcctgcgcccaccccacccccggcgcccggcatgctgtcggcgtgacccgtggcgggtaggccgtcggcatgccgggttgccgggctcgtgccggggatcgggggcacgatcgtcggcggctgggcggtgtcgctggggacggcctggtccaggttccaggagacgaggactcggtcggtgccgggttcgccgtagaagtcggggaggaagcgcaggccggtggctcgcaggacggcgaagttgaagtgggcgttgcggagggcgtaggggtcgaacgtccatctcatggtgcgagcgccggtcaggcgggcggcggcggcttgggcgtgtttgaggaggcggccgattccggtgccctgggcggcaggggctacgacggcggcctgtgaatagtggtagatctcgccgtcctggaggccggtgaagccgtagcagaaaccgaccagctcaccgttctcgcccagggcgccgatcacggtgccgccgttctcacggagggcggccagcaggcgcgggttcaggccccactcgggcgcggtgtagccgaaaacgctccgatagaggagcccggcagccgtccactcggctatcccgtccagctgccgcaccacgacgtccatccgcgcccctcctccaacgatcctgccgcgaccggtgccgcagtccccacccggcgccgcttcggctccggaccggttcgtcacaccgccgcggtcgccgccgacggcccgcgcctcggccacggcttggtatgccatggaggagatagcgaacgtatgattgccatcctgacgcccacagcgctcgttgacaatctccttcttcaaacttagcgttcgcatatgtcgtcatctgcgatcgcgcggctgcagcggtatgtcctggccgagtcgcctaccggggattcgcgggggctgggggcgttggccgagatgctggaggcggatgcggtggcggccggattcagcgtggggcgggaggcgcatccgaccggtgatcatctgatctggagcagggccgcgcggggggtggccggggagccgctgctttttctcagtcactacgacacggtgtggccggtggggacgctcagcgggatgccgtggcgggtggacggcgacgtgatccggggcccgggggtctatgacaccaagagcgggatcgtggcgctgctggcggcggtggcggcggtggaccggccgcatccggagatccgggtgatcgtggtggcggacgaggaggtcgggtcgccgaccgcgaccgggctggtcgaggcggaggggcggcgggcgggggtggtgctcgggctggagccgccgcatccgggtggggacctgaagaccgggcggcgtgggagcacccgggcgcggatcgaggtcggtggggtcgaggcgcatgcggcgctcgatccgggggcgggggtgaacgcgatcgacgagctggtcgatcagctgctccgggtgcgggagatcggtgcttcccggccggtgctggtcaacaccgggacgatcggcggcggtgggcggaccaacgtggtggccggtcaggcgtacgccgatctggggctgcggttcgccgatccggaggatgagcgggtcgtgctgggcgagttggccgggctgcgggcggtccgggcgcgggcgaccgtcggcacgcggctgctgtcgcaccggccgacgtggcgtccgggtccggccggggaccggctgctggcccggatcgccgggatcgccgccgccatcgggcagccgctggacgggcgctagctagctagggcgctgggtcggcccacgatcgacggcctggcaccccgcggcggcggcgcgcacgcccgcaccgagtgggtctccgccgccggcatcagcgagcggatcgccctgctcaccgccctgatcaccgatctggcgagccactgagcgggccggtgggcgccgcggacatcagcggtgaacggggcggacggatgcggtcacgtttgcaagaatcccggtaaaggtttggccgaggcgtcctcggggtaaccgcgagggggccgatggacctctcgggggtgacttcgatgctcaacgacaacgaacgccgcgcccttgccgagttggaacgcgatctggagcacgacccggacttctccgcccggatggccggcctcggcgtcgtgcagcccgagccggccttcccgatcgtcccggtgctgtgcgcgctgctgttcatcaccctgccgctggtgatgatgttcttcggctggccgggcgcgctgatcctgctggatctgttcaccgccgtcgtcgcggtcatcatgatccgccgccgggccgtcaccggctgatcggcggcgggccggccggtcaggcgcggacgtcgagcagatcgccggtgcggttcagcacgtcacggagctggctgaagtcgacgcccctgtcctgcagcaggctgaccaggctggacgcgctggtcgcggccgaggtcacgtccgaggtgtccatgtcgagcaggtcactgaccctggtcagcttctccgggtcggcgagcccggcgacctgtcgcccgtcgccgggatccgcagcgtcctgcgggcggggctgcggacggtagggcgcctgcgcctgcaggatctggtagggcgcggtgttgctgatgctgctgatcgtggtcactgtgactcccggtgtggccgtgacgcctgccgccgcggacggtggagttcatcggccggtccccgggaaagctctggaaatgaaaccgggaaagtcagccggtggtgatcgaggtcgcgctcaccacgccggacgagtcggtggcgccctgcacggtcacccggagtccggcggtcaggtcggcgacggtcgccggggtggtcttgctgaccgtggtggtgtccgacgcccggaccgtcaccgtctgcccggccgcggtctgcacgtacaccgtgttcccgtcgattctgctgatcgttccggacgtccccggtgcggccggcccggtcggcccgaagccgccgctgggcaggccggcgccaccggggaaggcgccggagaacgaaccggacggcgcggacgacgacgaggtggacgacgtcgacgaggacccccaccgcttgtgcacctggatcccgccgaggaagccgcccaccagcagcaccaggccggccagcaccagggtcgtccggttccaccagcgtttcggcgcggcgtgggcgatggcgctgttcaggtcgtcgtgctcgatgtcggtgggggtgcgcggcagcacctcggtgtcgtcgttcatctgggtcctcactcgtagcgcagggcgtcgatcggccgcagccgggccgcgcgggccgccgggagcccgccgaagaacaggccgatcagcacggacacacccagggcgagcagcaccgagccgggcaccaccaccggctgcacgccgacgatcgagaatcggctgccgatcagtgcggcggccacgccgaggccgccgccgatgacgctgagcagcgtcgcctcgatcaggaactggctgagcaccacccgccggggtgcgccgagcgccttgcggatcccgatctcccgggtccgctcggtgaccgtgaccagcatgatgttggtgatcccgatgccgccgacgagcaggctgatcgcggccaccgcgccgagcagggtggtgaacgtgtcggcggtctcggtctgggtggcgagcagttgggaggcgttctggatccggtacgccgcggtcccgtcgctgccggccggcgtcttcctgtccaggatggtggcgatctcgccctgtgcggtgtcgacgtggtcgctgtcgcgggcctccaccaggatcgagctgagcgtgccgtatccggcgatcacctggcggaccgcggagatcggcgcgaccgcggtgtcgttggcgtcgctgaagccgccggagctcttcgagtcgagcacgccgacgacggtgaacagcgcgccgccgacggtgacctgccggccgaccgggtcgaccccggagaacagttccgcggcgacggtctgcccgatcaccacgacgcggcgggcctgcgcctcgtcgtccgcggtgaacagggcaccggtcctgaccgggaagttggacgcgccgaaccagtccggggtggtgcccacgaacgagccgacgtcgtggtcgctgccgtcgtaggtgatcgtggccgaggtgctgaccaccggtgacaccgacttcacgtccggggccagcgccgggtcgtccagggcgtcggcgaccttcatcgtcaggccgctgctccggctggagctcatcacggtcagcgtgtcggtgccgagcgcggagatccggtcggcgatcgcccgcgccgacccgttgccgaccgcgaccagcaggatcaccgcggccacgccgatcaggatgcccagcatggtgagcaccgagcgcagcttgttggcggacagcccgcgcagggcgaaccggaggatctcggtggcgctcatgcggcgtgccgccccacgtggtcctgccggaggtccgcggtgatccgcccgtcgaggagcctgatcagccggtcggcccgggcgccgacctcctcctcgtgggtgatcagcacgatggtgcggccggccgcgttcacctcgtcgaacacgtgcagcacctcctcggtggcgtggctgtccaggttgccggtgggttcgtcggcgagcagcagggccggttcggtgaccagggcgcgggccaccgcgacccgctgctgctgaccgccggagagctggtggggctcgtggtcggcacggtcggcgaggccgaccacgtcgagggcgaacatggcgcggcgacggcgttcggcggcgcgcatccccgagtacgccagcgggagctcgacgttcgccaccgccgacgtacgggggatgaggttgaaggcctggaagacgaacccgatgagtttgttgcgcaccagggccagctggctgtcggagagccggctgacgtcgtagccgtcgagcagataccgcccgtgggacgggacgtcgaggcagccgatgatgttcatcagggtggacttgccggacccggacggtcccatgatcgccacgtagtcgccgcggtcgacctgcagcgacacgccgtccagcgcgcgcacctgggtctcgccctcgccgtacaccttgtacaggtcacggacgtccaggaccggccgggtcacgggcatggctcagcgaccgccctggccgccggccggcggggcaccgccgccgctgaagccaccggcgccgaagccgctgccggtgcggaatccggcgccgctaccggtgctggtggtgctggtcgggacgaccaccctctcgccggcggtcagacccgaggtgatctggtacgcgtcgtcgccctgcagtcccacctcgacctgccgcacctcctgctgcccggtcgcgccgagcacggtgacggtggatcgccgcccggtcgcggtgaccgccgccgagttcacccggaccgcgttgtcgacgctgccggtgaccaccgcgacgctgaccgtctgccccggcttcgcgccgtccggcgggtcgggcaggctgatcgtcacgccgtaggtgaccacactgttgctggtcgtcgcggtcgggtcgacggccagcaccttgccggtggtctccgcgcccgccaacgcgttccaggtgatggtggccgactggccggccttgagcgcagtcgcgtcggactccgagaaggccgcggtgatctgcagcctggtcaggtcggccagctcgatgaagccgttcgacgtgctcgccgaggagccggcggacgcgccggacccgccggatgccgcggcaccggacgaggtgccggccgaggtgccggcggacccgctggaggagccgcccagtgagccgttgaccgcggtgaccgtcccggccatcggcgcggtcagccgggtgccgtcgacctccgcccgggcgtcgtcgaccgccagtttcgccgaggtgaccgcgttctcggcgatggtggtgtcggtgccggccttctcggcgcgcgccagcgagtcgttcgcggcggccaggttggcgtcggccagtttccggtcccgctcggcggcggtggcgtcgacctgggcgagcagttggcccttggcgaccttgtcgccgaccttgaccttgacgctggtgaccgtgccggccgtggtgaacgtggcggcggcggtcgaggcgctggccaccgcgccgtcggcggtcaccgtcctggtcaccgtgccctgcgagacggtcaccgtccgcaggtcggtggctttcgcctggttgccggaggtggtgctgcggatcaggttgacgccccagatcgcggcgccgacgatcagtaatgccagcagggcgttgatcgccgtgctgggcctgcgaagggctctcacgatcccatcatgtccggtccgaccggttcgtggtgcggtgttggccgggattcccgcttcaccacgaacgtacgacctgatcgtcggcggtgagcccgtcggtcacctgggtgtactggtcgccgcgcagccccacggtcacggtccgctcggacgaccggccgccgacgcgcagcagcacggtgccggagccgccggagatgtcgtgcaccgcggtggacggcacccgcagcacgttcctggtctctccgacccgcacggcgacctgggcggactgtccgaccagcaggtcgctgggcggggccgagaaagagagcaccgcgccgtagcggaccagcgtgccgtccgaggtgccgaccgggtcgacctgcaccacggtcccggtcagcgcgtcgtcgtggtcggcgagcgtgatggtggcgctctgaccgacggccagcgacccggcgtcggcctccgggaatgcggcttcgacctgcatggtgtacgtgtcggccagggtgacgaaggtcttcccgctgctcaccgtgtcgccgacgctgcccgcgacggagaccacggtgccggcgatcggggcggtgatcacggcgccggcgagcgccgcctcggccctggtgacggcctccccggcccggttgaccgcctgctgcgcggtgagcaccgggtcgttgccggtgtccgggtagccacgggtggtgcaactgttcaccgccacggtcgccgtcgggctgacgtcggccccggcgagaaagccgcggtcggatgcggcggtggcgagaaagccgcggtcggatgcggcggtggcgagaaggccgcggtcggatgcggcggtggcgcacgcggtggccgcggcggtgacccgggccgcctggtcccgcgcgtcggtgagccggctcttcgcgtcggtgagcgtgttcctggcgtccgtcacggcggcggtcgcggcggtggcgtcgacggcggccagggtctgcccggccttgaccttgctgccggcccgcacggcgatcgacgcgaccgtgccgttgaccgcgaaggagagctcccgggtggtggccggtcggaccgtgccgctggtcgccacgtccagggtgacgtcgcccttgccgacccggacggccacgatcgtgctggtcgcgccgccctgctggtggctgtgcacgaccgcgagcagcgcgccgccgacgatcccggccacgacgatcccggcacctatcaacctattgcggtgtttagtccggttttgccccaacagcttgctcatgatcgtagattgtggctgttcacgtatccggacgggcccgaatctctggagcagacatgccgagctcgcatctccgccgcgccgccgtcgccctgtcgaccgtggtcctgctcgccgcctgcggtgactcgtccgacaagagcaacgacaacaccgacgcacccggcggtacgacgccctcggcctgcccgcagggcaccggcggcccgccgtccggcatggtgccgccgtccggaatggcgcaaccctcggcagtggccccgggcggcccgggttccggcacacccggcgcacccggcggcccgggttccggcgcacccggcggctccggcgcacccggcggctccggggtaccctagctagctagaccgacctcggcggcaccggcacccagggagccgtccccggggacagcggcacccccgacgccggtgacgccgccgtaccgggcaccgccaccccgtcccggggtgaatgacgacatccaggcccggcaacgactgcgccggcacaaccgggccctggccgagctcgcggccaccaagaccgaactggtcagcgccctgctgcacgagttgcgcaccccgctgacagccgccctcggcatgctggagatgctgcccgagcagaccggcgacccgctgctcgacgaggcgctaccgatgatcgcccgcaacctgcgccggatcgaacggtccaccgccgagatcgccacgatcagcgggatcgagagtggcagcctcccgctcgaccggatcagcttcgacctgccggccctgctcggtgaggtggccctggccgccggcgcggaatgctcggccgacccggcgaccggcctgatcaccggcgacccggcccggctcggcgaggtgttcagccggctgctggccgcggtccgggcactgaacgggccggccgcgatcgaggcgaccctggccggcaccgagtggcacgtcgccttcccgctccccgaagggcaggccagcgaccggctgttcacctccgggggagccggcggcaacgcgatggcgctgatcctggcgcgggcggtcgccgggcgccacggcggcagcgtgggcgtgcacagtgcgggcggaacggcgtacctgcgcatcgtcctgccggtctagagggtgtcagagtcgcccggtcagcgcttccacccgggtcagcagatcctgcgcggtgaacggcttgaccaggtagtcgtcggcgcccgcgtcgaacccggaggccacgtccagccactggccgcgtccggtgagcagaatgatcgggatgtccgcggtctccgcgtcgccgcgcagcgcccggcacacctccaggccggtcatcccgggcatggtgacatccaggacggcgaggtccggcacgtgctcgtgcgcgacccgcagcgcgtcccggccgtcgcggcacgcgtcgacgtccagaccgccggaccgcagcaccgtctcgacgatctccagcacggtcggatcgtcgtccaccaccagaacggaagtcaccccgtcctcctcgctcgctgccacccagtatcggcgcgggagacggccggagacggcaaaagcgcaaggcggggaagtcacgccaccctcccggccggctacctagagtggtcctcatggtggacgacggtgagcggatcaccggcgggcgactgtcccggtggaccgtcggacggatgctctcggccggcttcctgctcgccctgctctccctcgccgtggtcgggaccagcgcctatctgcgcatcggcgacctgctgcacgaccagccgccactgcagcactcgcacatggtgctcggtgacatcggcgcgctgaacgactcggtgcgggtgttcgacaaggtcgcccgggatgaccgcccgtcggccgaccggtgggccgacgcgttgcgcggctccgccgccaccgtccaggaacggctcgacaacctgcgtcacgacgcggccggggaccgggtccatcaggagtatctggggcagttgcagccgctgttcaccggccggctcgacgcgctgctgcgggccgccgacggcgccacgccgaaaccggacgtcgacaccagcgccatggacgccctgatcaccaagatgcaccagcacgaggaggatcagctcgacgaccggttgcaggcggcccgcagcagcgccacgatgacccggcagctgatcctctgggtgtcggtggccaccctggcgctggtggcgctggtcgcccgctggatcacccaccggatcaccgcgccggcccggcaggtgaccgcggccgcgcagcgggtgctggagggcgacctgacccggcgggccgaggtgaccgggccgctggagctggcccagatggcccgggcggtgaacgcgtcgatgaccgcgatggtcaccgcccacgacgaggcgctcgccgccaccgccgcgaagtccgccttcctggccaccatgagccacgagatccgcaccccgatgaacgcggtgatcggcatgaccggcctgctgctcgacaccccgctcgacacccgccagcaggaactcgtcgagaccgtgcacgccagcggcggcgccctgctcgtgatcatcaacgacgtgctggacttctccaagatcgaggcgggtgagctcagcctggacgagcggccgttcgatctgcgctcctgcgtgcagcaggcgatcagcctggtcgcgctgaccgccggcggcaagggcctgcacctgtccagtcacctcgccccggactgcccggccgcggtcctcggcgacgccggccggatccggcagatcctggtcaacctcctcggcaacgcgatcaagttcaccgaccacggggcggtcaccgtgcacgtcgcggccgacgctgcgcccgggcagccggaccggatcgaggtgcggatcgccgtccgggacaccggcatcggcatcccggccgaccggctgaaccgcctgttccgcccgttcacccaggtcgacgcgtcgatcgcgcgcaactacgagggcaccggactgggtctggcgatcagccagcggctggccgaggcgatgggcggcggcatcaccgtcgacagccaaccggcccagggctcgaccttcaccgtcacgctgctgctgcgcccggccggcccggcggaacagccggccccgctgcccgcggtcccggccgccgtccgcccgctgtacgtcctggtcgccgaggacaacccggtcaaccagcgggtcgccgaactgctcctggaacgccgcggccaccgggtcgacatcgtcgccgacggcgccgccgccgtcgaggccgtccaccggacgcgttacgacctggtcctgatggacgtccagatgccgatcctggacggcctggccgccaccgaacgcatccgcgccactccgccaccgcacggcgcgccgtacatcgtcgccctcaccgccaacgcgatggtcgacgacgaggccgccagccgccgcgccggcatggacgccttcctggccaagccgctgcgcgaaaccgacctcgacacgatcctcgccgaggcggcccggcacacccccgaagccggccccaccctagctagctaggcccgggccgccgccgccgccggaagcgccgccgccgccggaaccgccctgatccgggccgccgccgcccggtcggccgaaccggacagcatccgcgaatgcgtccaggcgatcgccggcaccggccccggcgaccgcgcccggctggcgacgatcctcgacaacttcgccgaccgtctgcccgccactctggaccggatggagagggcggccgccaccggcgacacccgcaacctggcccgcctggcgcacggcctgcgcggttcggccgccacgctcggcgcggtcgagttggccgcgctctgcgccgatctggaggcccgcgcccatcagcacccggcgaactcgatcacgctactccgcgacctgcacacgcaggccgccgaggtgtcggccatcatgcggcggctggcggcggacttcgccgcggccgcctgaacccggaccgatgaagatcaggaccacatgcctgatgtcgtgcgccgcggccgaccactgatcgccgctcattgctggagcatgggtggtggttccggtccgtcagggggctgggactggcatctgggccactggatcaccgcccatcgtcgctgaccccggttgagggcttgcgggagcgttcgcggggtctggcggtccgggacatcccgactggcgacagggcactgcgccgtagggaaccgaccccgcggacgccacgaacgccacggctgcggccggcgcgctcacgcctcgccgtcgaggagcaggacgtgcaggtggcgggggccgtggacgccctcgacgcggttgaattcgatgtcgctggtggcggacggcccgctgaaccaggtcagtgggcggcccgcgccgagccgggcgaccgcctccgggaccgaggcgacgacctgggccgggcgcagcaccacgaagtggatgtcgggcagcaggctgatgatccggcggccctggtcgggcgaggcgtccagcacgatggtgccggtttcggcgacggcgacggccgcggcggtcagcacggcctcggcggcggcgatccggtcccggggcaggtcgtcgtcgatcagggcggtggccggatgccaggacggcggcaggccgggtgggatcaccaccgggccgcggaccagcccggacaccgtcgcggcgatggccgtctcggggatccggtggaccgcggcccggtagtcgagcagccggtcgacgaggagttccaggtcggccgcagggaagtcgcggcggtaggtccgcgggatgtccggggccgccggcgcgtcccgcagggcggcacggatccggccgaggatcagatccttggcgctcatcgggcggcccaccagtcgcggaaggtctgggcggggggttcgggaaggtcgcgggcatcggtccaggcggacagggggatgccgcgccgccgggcgatgcgggcgagtttcgcggcgcgctgagccgacgcgtaccagcggggatggttcatcgcgaaggccgcggcccgcatggcggcgcgttcggccgccggatggggtgccagatcgcgcaggtgcaccaggatcgacgggatgtcgatccgcaccgggcaggcatcgaagcaggcgccgcagagtgacgacgcgtagggcagcgaggcgttgtcggcgacgccggtgagctgcggcgacagcaccgccccgatcggtcccggatacaccgacccgtacgcgtgcccgccggtccgttcgtagaccgggcacacgttgaggcaggcggagcaccggatgcagtgcagcgccgaccggccggccgggtcggcgaggaccgcgctgcgcccgttgtcgagcagcaccaggtggaagttctgcggcccgtcgccgggtgtcaccccggtccacatcgtcgtgtacgggttcatccgttccccggtcgacgcccgcggcagcagttgcaggaagacctccaggtccggccacgtcggcagcaccttctcgatgcccatcacggtgatcagcgtgtccggcagggtgaggcacatccgcccgttgccctcggattcgacgacggcgagcgtcccggtcgccgcgatcgcgaagttcgccccgctgaccgcgaccttcgtggacaggaacgtctcgcgcagatatcgccgggccgcctcggcgagcaccggcgggtcgtcggtgaggtccgggtcgacgccgggcatggcgcgcaggaagatctcccggatctcggcgcggttccggtggatggccggcaccaggatgtggctcggtcggtcgtggccgagctgcacgatgagttcggccaggtcggtttcgaccggctggatcccggccgcctccaaggcctcgttgagcccgatctcctgggtcgccatcgacttgaccttgatgacccggtcggcgccggcctgctggacgaggcgggtgacgatcgcgttggcctcgatcgcgtcggcggcccagtgcaccaccccgccgcggtcggtgacccgggcctccaactcctcgaggagttcgggcagccgggccatcaccgatgccttgatcgccgacccggcggcgcggagttcctgccagtcgggcagttcggcgatcaccctgccggacctgccgcggatcgtggtggtggcgtgccgcaggttgcgccgcagctggtcgtcggcgagcgcggtgcgggccgccgccgggaacggctcgtcgccgcgcaggtggccgacgccgcgcggcgcggtggccggcatgccgaggaaggtgctcatgcggatgccaggatttcggcgaggtgcacggtgcgcaccggtgacgaggcgcggcgcagcccgccgccgatgtgcatcaggcaggacgagtccccggccgtgcagaccgacgcgccggtcgccgcgatggcgctcatcttgtcggcgagcatcgccgccgaggtggccgcgttcttcagcgcgaaagtcccgccgaacccgcagcactgctcggcggccggcagctcgacgaggtccagtccgcggacgtgccgcagcagccgcagcggcttgtccccgacccggatcatccgcaggctgtggcacgtcgggtggtaggtcacccggtgcgggtagtgcgccccgacgtcctccaccccgagcacgtccaccagcagctcggacagctcgtaggtgcggccgccgaccgctgcggccgcggcggcgagcccggcgtccccggccgccaccagccggtgctgatgccggatcgagccgacgcacgacccggacggggcgacgatcacgtcgtacgccgcgaaggtccggacgtaacggcgcaccagcgggaccgcctcgcgccggtagccggtgttgacatgcatctgcccgcaacaggtctgttccggcgggaagaccacctcgtgcccgagccgctccagcagccgcacggtggccttcaccgcctccgggaacagggtgtcggcgaggcaggtcgcgaacagcgcgatccgcacggtcaccccctcacccgctcggcggcggcccgccacgggccgtcgtcgccgcgcggttcgtagcgcacgatctgttgagtctgccgcaccagcgcgcgcatcgcatcgagcccgccggagaccaccccggccgcccgcgcctggaccagcaggttgcccagcgcggtcgcctcgaccggcccggccagcacgggaaggccggtggcgtcggcggtgagccggcagagcagctcgttgcgggcgccgccgccgaccaggtgcagcacgcccggcgtgaccccggccagctcggcggcctggcgcaccgcgcgccgctgggcgagcgccaggctgtccaggatgcaccgggtgatccgggccggcgaggcgtcgttggacagtccggccgcgcggcggatccggccggccatgtcgccgggcggcaggaagatcgggtcgtcgaggtcgacgaccgcgccgagcagcggttccgcggcggcggcggtgagcaggccggtgatctccggggcgccccacccccgcatgcactcctgcagcggccagagtccggccacgttgcgcaggtagcggatggtccggtcgacgccgccctcgttggtgaagttcgccgtgcgggaggcggcgctgagcaccggccggtccagttcgagtccgacgagcgaccaggtgccgctggacacgtacgcgacatcgccgccgcaggcgggaaccgcgaccaccgccgacgccgtgtcgtgcgagccgaccgcgaccaccggaatgccccggaagcggccgatcacgtcgccggggcgacggatcggcgggaggaggtccgcccgcaaccccaggtccgcgatcaacgaggtggcccatcggccggtacgaacgtcgagcagccccgtggtcgaggcgttggtgtactccgcgccgatctccccggtcagccagtacgccatcaggtcggggatcatcagcagggtcgcggccgtcgcgtactgcggggtgtccgcggccgcgagcagctggtagacggtgttgaacggcaacgtctgcagcccgttcacggcatagaggtcggggacccgggcggcgatcccgtcggtccgcgcgtcccggtagtgcaccgggttgccgagcagcgccccggacacgtcgagcagcccgtagtcgaccgcccacgagtcgatcccgatgctgtccaccggaccggcccgggcgagcccgtccagcaccccgcggtagagcgccaggatgtcccagtacagggtgccgccggcgcgcaccggctcgttcggaaagcggtgcaccaccgccaggtcgaggccgtcgccggtgaacgtgccgaccacgacccgcccgctggcggcgccgagatcgacggctgcgaaccggtggctcatcgcaggaaggcggccgcgacgccgccgtcgaccgggacgtgcagtccggtggtgtgcgacagttcgccggcggtgagcacgaagaccgcgttggccacgtgctcgggcagcacctcccgcttgagcagggtccgctgggcgtagaactcgccgagccgctcctgcggcaccccgtagacggcggcgcgccgcgcaccccagccggccgcgaagatccccgagccacggacgacaccgtcggggttgacgccgttgacgcgtacgccgtgatcgccgagctcggccgccagcaaccgcacctgatgcgcctggtctgccttggcggcgccgtaggcgacgttgtccggaccggcgaacacggagttcttgctggagatgtagacgatgtcgccgcccatccgctgcgcgatcagcacccgggccgcggccctggccaccaggaacgagcccttggccagcacgtcgtgctgcacgtcccagtcctgctcggtggtctccagcagcgacttcgagagggacagaccggcgttgttgaccaccaggtcgaccccgccgaaggcgagcaccgccgcgtccagcgcggcgtcgaccgcggccgcgtcggtcacgtcggcctcgacggcgatcgccgcgtcggtgccgccgatctcgtccgccacggcccgcgcggtggtgacgtcccggtcggcgatcaccacgcaggcgccctcggcggccagccgcagcgcgatcgcccggccgatcccggagccgccgccggtcacgaacgcggcccgggcggccagtggtttcggcttcggcatccgctggagtttggcctcctccagggcccagtactcgatccggaacttctccgcctcgtcgatcggcgcgtaccgggagatgctctccgcgccgcgcatcaccgtgatcgcgttgacgtagaactcgccggccacccgggcggtctgcttgttcgccccgaacgagaacatccccacacccgggaccagcacgatcgccgggtcggcgccgcggatcgccggagtgtccgcggtggcgtgccggtcgtagtaggcgcggtagtcggcccggtagccctcgcgcagctcggtgagccgctgcgtgatggccgcaagcggcgcgtccggcgcggtgtccaggaccagcggcttgaccttggtgcgcaggaagtggtccgggcaggaggtgccgagcgcggccagctccgccagccgctcgctgccgacgaagtcgaggacgacgtcgtcgtcggtgaagtggccgacctgcgggcggtcggtggaggccagcccgcggatgatcgggaacagctcggcggcccgctcacgtctccgctgccgcggaagagccgcggtccggacgttgccgaacggctcgcggcggccgtgccgctcgaggtatgcggcggcggtgctgatgatctcctgcgcgtgggcctcgcactcgtcgctggtcgcaccccacgcggtgatcccgtgcccgcccaggatcaccccgatcgcccgcggatgcgcccgctgcaccgcggcgatgtccagacccagctggaacccgggccggcgccagtccacccaccgcacccggtccccgaagatctccctggtcagcgccggcccgtcggcggcggtcgcgatcgcgatcccggcgtccgggtgcaggtggtccacgtgcggcacgtccaccagcgcgtgcatcgcggtgtcgatgctgggcgccgccccaccccgcccgtgcaggcagtagtcgaacgcggcgaccatctcgtcctcgcgctccacccccgggtagacgccgggcagcgcgcgcagccggtccagccgcagcaccgcgaggccctgctcggtgagggtgccgaggtcgccaccggagcccttgacccagatcagctcggtcggctcgccggtcaccgggtccacctcggcgcccttggcggaggtgttcccgcccgcgtagttggtggtgcgcggatccgcaccgaggcggtgcgacctcgcgatgagcgcggccactgccgggttcgtcatgagcgatcctcaccgatttatgaaacgtttcacgagtgcggtcagattacgcgcgcctcgaccgcccggtcaagaccacggcgccccacgacgaaccgccggcgtccaccgctgcgaggcgaaacgtcgaggtggcgcgcgccgtcgcaccgacccgtgatggtcgcggtaggacgatccgtccatgatcgcccttgattccggtatttccgctcttcctgacatcgccccgggtgcggatttccgacagcggggcggcggcgccgatgtgcgacgttcagcgccatgcatcgtcgtcgctggattgccggggtcgccgtggcggccgtcgtcggtggggttccggtgcccgtgctgggcgcggtcaccccggtcgcgaaaatcaactttcagcctgccaccgcggccgtgccgggcgggtacaccgccgacaccggagccgcgttcgacggcgcgcaggggtgggtgcggcaggacagcctgagcagcaccgcccacgtgccgctggatctgacccgcaacacgcgggaccgcgcgcgtgcgggaatcgatcaacggctcgacaccatcattcatctgcagtacggcgatgtcggcggcaccaacggcatcgccaccgccggcgcctgggagtacgccgtgccggacggcacctaccaggtgaccgtctcggccggggaccagccggcgtacgacagccggcacaccgtccgcgtcgagggcgtcaccgcgatcagcggtttcgtgtccaccgcggccgccgagttccggccggcgacggtgaccgtgccggtcagcgacgggcggctgaccgtggacgcgatcggcggcgtcaacaccaagctgaactacgtggagatcagccgggtcaccgcggacccgcccaccgggctgaccgccacccccggcgacgcccaggtggcgctggcctggagcgggaacgcggcgagctaccgggtctaccgcgggagcacgctgctggcgacggtgacccgggcgtcgtatctggacaccgcggtcaccgacggcaccgcctacgagtaccacgtgaccaccgacggcggttcgtcggcgacggtcggcgcgaccccggccgcgttcgccctcaaggtggacttctcggatgcggcgaccgcgccggccgtcggatatgtgcgggactccggtggggcgtacacctcgacgcgcggctacggctgggtggatctgggtgagggcaccccggtcgacctgaccggcaacgggcgcaaccggaacccggccgccggccagagcgatccgcggctggccaccttcgtgcacgcccagcttccggccggcgcgccgggggtggccacgccgggcgcctgggaggcggccgtgccggccggggtctacacggtgaccgtcgcggtcggtgacgcgggcaccgcggtggacagcgtgcactgggcgaatgtggaggaccagaacgcgatcgccgggttccggccgagcgccgcggtcaggttcgccgccgcgacccgcacggtgcgggtcaccgacgggaggctgacgctgagcccggccgggggtacgaacaccaagttcgactacgtcgacatcgccagcgtgccggccgccggggccgttcccgcggtgcgggccggcacgccggcgaacggcgcgaccggcgtctcccccaccaccagcgtggtcgaggacctggtgctgcccaacggcggtgtcgcggccgcctcgctgaccgcctcgacggtgaccctgacccggctcagcgacggcgcggcggtgccggccaccacgatcaccagcggcggcggggacgtgatcaacctgtcgccgaccgcgccgctggcggtgggcacggcgtaccggttcaccgtgaccggcggggtcaccgacgtgaccgggacggcgttcacgccgtactccatcgtcttcaccaccggcaccggcggaaacccgggcggaccggcggccttcgacaaggtcgtgggcgtggccaccggggcgtcgttcacctcggtgctgaccgggccggacgggcggttgtacgccgggacgctggacgggaacgtctaccgcttcccgatcaacgcggacggcacgctcggcacgccgctgatcatcggctcggtgcgggcgaacgccgcggcgctcgggctgcccggcgcgcccgcccgcacgatcatcgggatggcgttcgacccggcgtccacggcggccgcgccgatcctctggacaaccgacaattacgagtacgtgggtccgctcgacgtcccggactggtccggccggatcggccggctcagcggggccgacctgggcacctacaccccggtggtgaccggtctgccgcgctcggtgaaggatcacgagacgaattcactggcgttcggcccggacggcgcgctgtacctgacccagggcgccaacaacgcgatgggcgccgccgactccacctggggcaaccgggcggagcacctgctcagcgcggccgtgctgcggctggacccggcgcggttgccggcgacgctgcccctgaacgtgcagaccgagcagggtgggagctacgacccgtacgccggcaatgcgccgttgaccctgtatgcgaccggcgtgcggaacgccttcgacctggtgtggcatcgcaacgggcacctgtacacgcccaccaacggctcggcggccggcggcaacaccccggccaccccggcgacgctgcccgcctcgtgcgcgcggcgcggctacaccgggccggtggtgccggcgctcaccaacgtgccggccgcggagaccgattacgtcttcgacgtgaagtccggccggtactacggccacccgaacccggtgcgctgcgagtgggtgctggccggcggcaacccgaccgcgggcgcggacccgttcgaggtggccgcctacccggccggcaccgcaccggacccgaacttcgacctggccggcacatacgacgcgggcctgcacgcctcggccgacggcgcgatcgaataccgcggtggcgcgctcgacggcaggctgctggtggtccgctactcggatgggcaggacatcgagacgttcgacgtggccgcgtccggcgcgctgtcgaaccggaccgtgggcatcaccgggctgaccggtttcagtcagccgctggacgtcaccgaggacgtcaccaccggcaacctgtacgtgaccgagctcggcgccgcccggatcaccctgctgaaaccacacgcctgaccgctcggacgccaccgcccgggcgcaacggcccgggcggtggcggcggggcggattcagatgagccagcggtgcttgcggaccagcggcaaccgggtccagacgcggcccagaccccaggtgtgagctgcgtggctgcggccgatggtcgtcatcgcttcctcctccatcaatctcgtcaccccgacactgctccgtccgccgcgccggcgcccgggtccgaccaccccacccggtgggccgaaagtcccgacgtcagccgaccttgaccggctccggggcgggcgtgtccgcgcggcgccggaccacggccagcaccaccaccgcggcgaccagggcggtgccggccgcgacgtacaacgtctggtggagaccgtcggcgaagccggccggtcggccgtgcgcggcgccgatccggtcggcgaagatggtgccgaagaccgccaccccgagggcgaaaccgagctgccggaaggtgttcagcgccccgccggccatgccgctgcgctcgcgcggcacctcggccagcaccgccgaggacagcgacggcagcacgcagccgacgccgaggccgaccacgatcaggccgggaatcaggatccggccggtgctgcccgcgtccagccgggcctgcagcaggtcaccggccgcgatcagcaacaggccgaggccgaccgtccagcgcgggctgaccttctgcaggaacttaccggcggccgcgccgaccaccagcgaggcggcggccatcggcagcgcgccgaccaggccggcgtcgaccggaccgttgtgcagcacctgctgcagccagaccgtggcgaacgggaggtagccgaatgcggcggcctgggtcaggaacgcggccaggatcaacgcggcgaacggcgcccggcggaacagcgccaggtccagcatcgggtggtcggagcgcagctcggcgatgatgaacgcgaccagggcaacggctccggcgccgaacgcgccgagcgccacgccgtcggtccagccggcgtcaccggcgcgaatcaggccgtacgtgacggcggccgccgccacggtgaaggtgagcgtgccgggcaggtcgaaccggccgccccagggcgccttcgactcggtcacgccgcgcaccgtgaaccagaccgcgaccaggcagaccggcaggttgaccaggaacacccagcgccagccgaaatgctgggtgagcaggccgccggcgagcgggccggccgccgcggcggcgccgttgaccgcaccccagatgccgaaggcgacaccccggtcgtggccgtggtaggtgacgttgagcagggcggcggtgcaggcgaacatggcggccccgccggcgccctgcaggacgcgggcggcgatcagcgcctgctcgttcggcgcgaccgcgcacagcagggaggagacggcgaaaatcacgatcccgatgaggtacgtacggcggcggccgtaccggtcggcgagcgagccggcgccgagcagcagggcggcgagcgcgagggcatagccgtcgagcacccactgcaggtcggcgtagtcggccccgaacttgccggcgatcgacggcaacgcgacgacgacgatggtgacgtccaccagcagcaggaaggtgccgaggcagacggcgatcagtggtgaccatttgcgcatgcacagcagaatgccgtgcgttcccctgaacgctggcctcgttccgcccatcctggcggatctcgacagccgatatggtggcgtggtggaaatcgacacgctggaccgacaggtgacacacgcgctgcggatcaacggccgggccggctaccgggagatcggcgcggtgctcggcgtctccgaccagaccgtcgcccggcgctaccgccggctgcgggaggaggcggggctgcgggtcgtcgggttgcccaaccccatcgagctgcggtacgagacctggacgcttcgcctgcgcgccgcccccgacgcggccctggcgatcgccaacgccctggcccgccgccccgacaccacgtgggtgtccctgacctcgggcggcaccgagatcgcctgcagcgtgcacgtgcccgcctcgtccgaccgcaaggccctgctcctgcagcaactcccgcgcacaccccggctcgtcgcggtcagcgcccactgcgtgatccacaacttcgtcggcggggcggtcggccccgacctgcgcgacgacgcgctgaccgccgagcagaaggcggcgctgtccccgccgcggaccacgtcaccggcccacctgacccccggcgacgcgccgctgatcgaagcactcgcctgggacgggcgactcagctacaccgaactggccgcgtcgaccggctggccggaaacgaccgtgcggcgacggacgcaggagctgttcggatccgggtcgctctacaccgacgtggagatcgaaccggaggtgttcggcttccgggcggcggtcaacatctggctgtcggtggcgccgtcccggatggcgtcggtcggggcggcgctcgcggcacacgaggagatcgtgttcgcggcggcgacgaccgggccgacgaacatccagacggcggcgatctgccgcgacatgccggccttctaccgctacgtcaccgagcggttgagcctgctggacggcgtggagcggatcgagtccgcccccgtcctcaaacacgtcaaacaggtcggcgcggtccgctgaccccggcgcgggtcagcgccagaagacggcgacggcagcgttcgccagggtgagcgtgatgatgccgatgtagtggcccttgttgaccgcctcgcgcttgcgcgggatgaacaccatgatgaagatcatcacggcgatcaccagcttgaccacgagcttggccgggtccggctcgtgatcgccgccgccgcgcagcggagcggccaggccgagcccggtgaccagctggatgatcgatccccagaggaccgccgggctgatccggaacgtgccggacaggaactgcgcgatcgacccgcccagcagcagggcgaaaccgacgaggtgcacgaagagcaggatcaaccggagagcttccacagcgcgacagcttgccatttcccggcccgctcgatcaatccgggacccccgggtcacccgatccggccacccgcccgtcagcggcgggcggctccggtggaggcgcgggcgaccagggccgggacgaacgtcgcctgctcgtgctcgtggtccgggtcggtggcctcgtccaggaccagccgggccgcggtgcggccgagttcctgccgaggctggcgcaccgaggtgagcggcaccgcggccgcggcggcgaagtcgatgtcgtcgaaaccgacgatggccaggtcgtcggggacgcgcaggccggcggtgaccgcgtgctgcagcaggcccagggcgagcaggtcgttggcgcagaacgcggcggtgggccggcggcgcgagggcagcccggcgaggcgttcaccggcggagcgtccctcgctgacggtgagcgcctcggtgggcacgtggatcaggtcgccggcgggcctgccgaactccgcccagacctcccgggcaccctgacagcgctcccggacctgaccgatgctggacggtccgccgacgaacgcgacccgctcgtggccgcgatcgatcaggtgctcgacggcgatccgcccgcccaggatgtcgtcgacggcgaccgagcagtgcccgccctcgcggctgagccggtccaccatgacgaacgggatgccgcgccgggcgatgtcggccaggtgcgcggcgtccgggtcgaccggtgtgatcaggatgccctggacccgctgctggaccaggcggtcgaggtgtttggcctcgcgctccacccggccgccgctgttgcagacgaacagggacaggtcggcggcgtcggcggcgatctcgatgccctcggcgacatcctggaagaacgggttgccaccgtcgagcatcacgtacgccagggcgcggctggtgccggcgcgcagctggcgggccgactcgttgcggacgaagcccagctcggccatcgcccgctcgacccgttcccgggtgccgccgctgaccaccgcgggccggttgagcacgttggagaccgtgccgagggagacgccggcggccgccgccacgtccttgaccgacggcgcgcggccgttgcgcggctgctgacccaaccccgtagccccctcgctggaacgctgattgaaacgcattctaggtctgcgcgacccctccccgtacgtcagcatcgcaccgagaatgaaacatttcaaccgacgaccgtgagctgggcggccacgatccgccagccgacgtccgcaccgaacgcccaggtgcgcgtgtagcgcagccgcgcggtcagcggcaccccaccgaaccggccggtgacccggcacaccacgaaggtgaccccggtcgtcccgaccaccagcgactccaggctctcctgggtcagctcgtccaccaccgagccgcccgaccggtagccctccagatcgtccgccttgctgaaccgggtcccgtccggtccgatcgccaccagccggtcgtcgagcagccgatccaactcggcgacgtccccgttgcgctgcgcttcctgcagacgctgctcggcgatcagcagcgccgcgtcccgatccggctcacccatgcgccaacagtaggaacccggccgcccggcgtccgccccctctgccaacggcagaagccggccaccgacgacccggccacatccccactcccacgccggaagtcagcaaccagaacggcccggcgcagacatccgcccctccccctacgccagaagccggcaaccagaacggccccacgtcgacatccgccactctccccacgccagcagccggcaaccagaacggccgcacgtcgacatccgccactctccccacgacagcagccggcaaccaactgcccggaggcgaggacgagcgacccccggcgggtctcgtgaccggtccgcaatcgcggtcggctaccgtccgtgcccgtgatgcgttcccggttcgcccccgccgccctgctctgcgcctgcctcgccgctctcaccgcctgcagcgccgacgactccgacgccgccgctccgaccggcgccaccacccggggctcagcacccgtcgccgggaacgactcagcgcccgccggaaacggctcaacccccgccgccgggaacggctcggcaccggcggccgggaacggcacggcggcggccggcgcccccggcccggggtcgaccgacgacaggaccgtctgccatctggtcgaccaggccggcagcgtgatgaaggccggcatctcgcaggtgcagcggtcggacggtcacgtggaacccgccgacgcgaagaacgtcttcacgaccttccacaccgcgatcgacaacgcgctcgccaaggccgccgactccgacgtcaccaccgccgcccgcgcggtgtcgaaggagatcggcacggcggccgccgcacccgatccgatcagcgccgccgccaacgccgggttcgacgttctcagcaccaagctgaccaccgcctgccagtccgccggcgtcaccatcaacttctgacggccacggccggtcagcgactggcggactcctccgccggccccagccaatactcggccggggcgatgccgacgccttcgacgaccggccgcggatcgtccggagaggcggacgggtcgaggtcggtggcactgcggtagcccatcgagaagatggtgaagccggacgggaatgtgtagccgatgtcgaacggctccggccggtgcccgagagagatcagctcgtcgagcacgtcgtccatgaaccggtaggtcagctgcaccccttcgagggtggcctgctcgccgccgtcggccgagaagcccagctcgaccagctcgacggtgtccccgtcgtagtcgacgaccagggtcggctcggtgtcgtagaccgcgcgcgccgagatgccggcgtgcatgggcgggccgaggcgggcctccaccacatctctcgtctcgcccaccttgaccagtgcgacgccctcgccgggaagaatctccatgcccggatgttgccaccacccaccgacattttcgaagcgtcggcgtttaccgggaccgaagttcacgccgcggacggtaccggacctgcggtgttgcggaatctgcgaattccgacgtccggcgcagcggcagcagtgagcagaagaccacgaaggcggcgatcggcagcagatcgaggtccaccgagatcgccgcggtgccgacgccgaacagcagcggcgtccagaccggcagccggcgggcggcgaccagcagcccgaagaaccccagcatgccgagcgggaacagcatcggcccggccgtctgcagcgcatcgggcatcggcgcggcccgccggaacccgtggaacaggtccccggtgatcacccacaggaagcaggccaccccggcgagcgcgaccacggtcgcgacggtcgccaccgggcgcccgccgagcaggccgcgcagcccgaccgcgagcacgccgaagaggaccatggcgacgaagaacgcgacgtgtcccacgttccagaacaccccggagccgcggcggccgtccagcccgtccaggaagcggcacacgccgtacgtgaggagcagtgccggagcggcgaccgccgtacgccggatgatgaccgtgatcgatgacatgggtcgacgctagagcggcgggcaccccgggcagcaccggcacattccctgattctcttctccgggtccccctgagaagtcctcagatattcctatcgcacagataggaatgctatgctcccggccacggcgaccgacggccggagcagcggagacgccaccaggcgcgccgaccatctccggccgccggcccgctgtaccaccgccgcccggcaaccgtccggggctgcccgggcaacccccggcgcacccggccggccggacacttcaggcggcccgacgagcgcaagcggaggcacgcgtgaccatcctgaccgagcaggccgccgaggacttcgtcgcggcccgcgccctcgcgcccgggcggcccgggttcgtcggcgtcgccgtcgacctgctgctcgatccggagtccgcgcccagcgcccgccgcccgctgcggcacggcttcctggacgcccgctcgccgcgggtcgcggtggtcagcggcccgccgtcgccgggcatcgagatcgccctgcgccggatgtccgacgacctggcggccgccacccgggtcaccgaccagcagggcctcacggtgctgccgttcgccaccgacaccgtgcacccggacagcccggcgcacgcctacggcacggcgaccgcgggcctgcgggtcggcctggaggcggggctcgacgaggacggcccgctcggcctgcgccgccgctgggtgctggcgcacactctcgccccggtgctggccgcggccttcgccaacgcgccgctgacgcacggccgcccgtccggctggcgcagcgtgcgccaggcactgcgccgcgacctgccggtcctgccgggccacgcggtcgctgcgcttcccgcgccccgggtcccgggccatgtcacggagggcttcggcgcccggttcgccatcgatccgcgtacgtcatgggccgccgcggccctcgacgcacccaccgtgaccggccgcagcctccgggaccggctgcgcgccggcgcccgtctgaccgagagcgatctgctgcgccacctgaccgccgtgcgcccgccggtcgccgcccgcggtcacctggagatcgacgcggtcgaccggcagcccgggcacggctggcgcctgccggccgcgatgatcaccgcgctgctggacgacccgcgcgccgccgaggaggcctacgccgccacggtccacctggccggcgagcccccggttgtgggagcgggccgcccgcgacgcgctcaccgacccggtgctggccgacgccgcgcgggcctgcttcctggccgcctacgccagcttcgcccgcaacggcgccgcccgcgagctgcgcgacgccctggccgacttcaccgacgcgtacgtcaatcggggccgctgccccgccgacgacctgctggaccacatcaccggccgggtctgaaccggccgcgcctgaacggccgcttctgagcccgccgcgcctgaaagggccgggtctgagccggccgcgcctgaacggccgcatctgagcccgccgcgcctgaaagggccgcatctgagcccgccgcgcctgaaacggccggtcgtgcatcggccgcggccgaccggccgggtctgatctgccgcaccgaggccgcaacggaatcgatacgtcgtggcctcggtgaagaccccttgttgggctaccgtcctggcgtgaacgaggaatttcccgggcagcccgccagcgatcccctggcgtccgccgcccccgccagtgatgcgctggccgcaccgcccacggctccgctgtacgacgcaccgcccacggctccgctgtacaacgcggcaccggcgtacccgacgccggacccgccggcgacgctccccttccccgcaccggcacagccggcctcggcacccccggcataccagccaccggcataccagccaccggccgccgcaggcttcccgcccccgggtttccctccgccgggcttcccaccgccgggcttcccgccgccgcccggctacccgggccagcagcccggctaccccgccgcgggctacccgttcggtccgcccccgtccggcatcgtcaacggcttcgcgatcgcctcgctgatcttcggcgtcatcggcggcgtcttcttcgcgatcggcttcggcatcgccgccctgacgcagatccgcaagcgcaacgaccgcggtcgcggcctggcgatcgccggcctgagcctggccggctgctggatcctcggcatcgtcacggcggtcatcatcggggtggcggccgacgacaccccccgggcgaacgacctgaccaccggcagccgtcccacctcgatcgccaccacgcccaccaccgtgccgaccgaggcgcaggatgtgcggaccgagaagctggccccgggcgactgcatcgagaccctggtcgagcaggagacggtgcgcgacctgccggtgatcgactgttcgaagccgcacgagggtgaggtgtacacggtcttcaccttcccgaagggcgacttcccgggtgacaccctcgtcgagaaggaggccgacaagcgctgcggccggtccctcgacccgtacgccaagggcaagtacgccagggccgactacttctacgtcttcccgtccagggagtcgtgggcattcgaccgcggggtcacctgcatcgcggccgcccccaagcacggcaggtacgtcgggtcgatggtgaacaggtgacctgagccaccggctcgctccggcgacgtgccgggcctcgggacgcccggccggcggcgtggcggcagctacacgccacgcgcggtgctcgtgctccggggccttcgcctgctcgtccgacgggacagcggcggccgctcgaccgcagcccggccggtgtacgtcaggccgcccggcgcgcgcgggaccacgtacgcggcaatcgtcgaagtcttctcgcggaccgggagcggcagcggaccgtgaccgggcgcttcttcgcggccgccgacggcggcgaccgcaacacactgatggcgctgctcgcgccggagggggacgccgacggccgggtggcggtggttctcaacaccgccaacccggacaaactgtcgtcggttcaggccggcaccgtgcggatccgctgatcgtcaggcgcgctggcgggccttgcggcgctcgccgatctcccaggcgatcacgtactggcggatcatctgggccaacgggtccacggtcttgaagatcagcaccacgtggtggccgggctcgtcgcccgcctcgcggaccgcgtacacccggcccttgagctccgcctcgccgttgccgagccagaccagggcgcgcagctgctcgccctccttgaacatcttgccctcgggcacccagaaccgcaggccgccctcgctgatgtcgagcatccggccctgcaggtactgcggcccccactcaccgaacaggcggatcggcgcaccggccccgccacgggcgtactcgcgccggttgctgatcaccggctccgccgtcgggaacaggttccaccggaacggcgccccgtcggtcacgctcttgagcagcaccggcatcaccacccggctgcgcggcggcacccagaacacgtcgaactcgtagcccggcaggaaccccgacggcccggccgtctccagcggagcggccacgctgaagacctccccgtccaccgactccagccgggagcggaagttcacgccctcgcccagggccaggaacatctcggaaccgatctcgggcaactccatcacacgccggcctttcacgtcgcctggcccgcactccgcgggtcgtcctgcaaggtcggcggcgccccctcgcccttgagaggtccgggagttgcgatccgagtctctccccggcgattccgctcccggtcggcaacggcaaaacacattcacattcatcatgtcgtgcgctgcggccgataactgatcgccgctcccgccgctcccggacccggcgattccggccgctggcgcggccggaacgaatcgccgcgccctaccgtccgtggatggtcgcggaaagaccgcgggctaccgcaccagtcccaggatgacgtccatgtccttgagcttttcggcgccggtgccgagcaggccgtccgggatgatgagttcgtcgagtccggccgcgcggtattcggcgatggcgtcggcgagcgccgcccggctgccgccgatcaccggaaccggcagattgtccggcaggggcccgtcgacgaccgtgagggcctgcgcggtgcgctcgatggtgcgcgggtcccggttgatctcggcgcagaaccggtccaggaccgccgatttgtgcgcgatgacctccggatggccccaggtgttccacatgtcggcgtattcggcgacgacgccgagcatccgtttctcacccttggcgccgatcatgatcggcagcgggtgctggaccggtttcggttcgcataccgcgtcggtcagctggtagtactccccgttcagcgtcgtcttcggggtacgcagcagcccgtgcagcacctgcagcgcctcgacgaaccggtccagcagctgcctggtcggcggcagctcgatcccgtactgctcgtgctcgttcacctgccagccggcgccgacgccgagggtgaaccggccgccgctgatgtggtcggcggtgaccgccatgttcgcgaggaccgccgggtggcgatacgtgttgccgtagacgagcgtgccgatccgcagccggggcaccgcggcggccaggccggcgaccagggtgccggcttccagggtgggggcgagcgggtcccggccggggccggcgttcggcatgaagtggtcggcgatccagacgccgtcccagccggtctcttccgcgtgacgggtggcctcgagaatgccggaccaggactgaccggcgccgggccagatggagatgcgcatgcggcaaccctaactatctcagcggtggtacggcgtggtcgtaccgaccgcggcgaagcccagccgcagcaggatcgggcggctctggtcggaggcgtcgacctgcagatactcgtacccgaggtcggccgcgatccgtgcccggcaggccaccagggcacgatagacgccccggccccgccatttctcgacggtgccgccgccccacaggctcgcgaacgcggtgccctcgtgcacctccatgcgggcaccggagatcggctcgtcgccggccatcgcgacgaacgcgcgcaggcttgccggctcttgatgccgccacgagccggccggttccccgaacgccgactcgctggcccggatcagcaaggccaggccggccgcgtcggtcaccggcaccagccgcaccccgtcgggcggggccacgtccagatccagttcgccgatcggcgcgatcatcagcgattccggctcacccggcacgaaaccggcccgttccagccgggcgccgaggtcggccgggcggtcgtggccgtacgtcttccattcgaacccgacaccacgtccggcaaagtagcgcacctgctcggcgatttccgcgtccgcggtctcctcgtcgagatcggaccacaccacggcattccagtcctgcgccgtgccggcgttgcgggtgtaccggaggccgcgttcggcgcccggcatgtcgcggcgcatctgccgatcgaacagcgccattacctcatcgtgattcacgcgcccatccaaccggactcgttcccggctgtccgccgcttttcccgccggcttccagctgcctcaccagccggtcccggcagtccggccactccgcagcagcggtgatcgcgaacatggccgagtcgcgcagcagcccgtcctcgcccggcgcccacgacttcgaccggttgcgcagcacacccgcgaaccgcgccccgacccgctcgatcgcggcccgggagcgcgcgttgcgggcgtcggtctcgaggtcgatgcgcatcacgtgccgcgagatcgccggcgtgccggtggccgagcggctgccaccggacccgacgaccctccagcaccggcgcttcacgaccgttgagcagcacggtccacgacggttgagcagcacggtccacgaccgttgagcagcacggtccacgaccgttgagcagcacggtccacgacccccgggaggccggtcaggcggccgacagcacgtcgacgacgaaccgcagcgcgccggccggctggccaccggccggcttctcgccgtaggccagcgccggcgggatgtcgagctgcacccggctgccgaccggcaccccgatcaggccctggtcccagcccttgatgacctgcccgccgccggccgggaagctgaacggctcctggcgcttccaggactcgtcgaactccttgccgtcggcgtaggtcaccccgacgtagttcacgctgatcgtctgaccggcctggaccggcgcgccggtgcccttgatcagggtggtggtcttcagggcggtcagcttgccggcgcccttggtgaccttcggcttcttgccgagagccgggtcggcgcccacgggcagcggtgggaacgtcgcggccggctcggccgccgcgctcggcggggccgccgcatcggaggcggccgcactcgcggtgcccgcgctgccggagccggaatccgacgacgagtgaccgatccagacgatcaggccgacgaccagggccagcacgacgaccgcggccccgccgatggtcagcagctcccggcgtttccgctgcgcccgggcccgcgccttggcagctttggcctcggcccgcttctcggccttcgtcttcagcggcggggcgccgcggcgcggcgaagcggcggcggaacgcttggcagtcacattgccacggctggtcacgggatcaggcacggcccgacaatacacacttccgccgatgccgtctggaatgctcgggcccatgcccaccttcccgcccaccttcgccgacacggtgatcggccagccggccaaggaccagttcgagtcgttcctcgacgaacaccgccggcgctgcgcgccagcctggacgacctgaccgaggagcaggcccggcaccggctggtgtcctccgagaccacactgctgggcctggtgaaacacgcggccttcgtggagcgggtgtggttcgacgaggcggtcaccggccgctcccgcgcggagatcggcatcccggcggactccgccgactcgttcctgcttgacgaggacgacacgatcgccgacgtccagcgcgcacaccgcgacgcctgcgccgcctcccgccgcgcgacagccatgctggacctcgacgacatcctgaccggataccgccggggtcccctcccgctgcgctgggtctacctccacatgctgcgcgagctggcccagcactgcggccacgccgacatcctgcgcgagcagctgctcgccggctgaccgcgccaccgcccagccgctgcatgccgcccgcgtcgcgccgctgaagtcgctatcctgggggcgcgcgaaaacactgccccgtcggtagtcggggcgtcgtccggaaccggacggcccgtctcctgccggtcatgatcatcgaccggttgtccagcgcaggacgcttgccgcctgcgcacaggagacaccatggccactttcacgctctatttcgacaacccgttctgggtcgccgtcctcgaaatcccggacgccggcctggtccgcgccacccgccacgtcttcggttcggaacccaccgacgccgagctctaccagttcctcctccggttcggcggcaccctcctctcccgcgccgaggccaacccaccggcgcccgccactgaccggccccgacgcaagccccggttggcggtgaccggcctgggcaccgccgcccagcaggcggtgaaaaaggaactggagcagcggaaacaggaatcaagcctgcgcagccgaactcagcgcgaggagcacgacgcccatcgccggcaagtccgccaggccaaagcccgagcccgccgccgcggccactgacagccagccggcgcgaccactgacagccggccggcgcagccactgacagccgggcgccgccgcagccgccgacagccggccggcgcagccactgacagccgggcgccgccgcagccgccgacacggccgccaccgccgtaatgacgtccgggcgccactgcggctgatgacatccggccgccaccggagcctttgacgggcggttgccggcacaaccgtccggtgcggtaggtgcgggcgggctgttcagtacggcgtaccgccggaatcgggtttcaggtttcctggaaggactcctgaccgatgactcgtagaaggtccagatagttggcggtgggagtgcccggtggggcggtgagcaggatcagacgttggtcctccgtgggggtcaggagcatttcgaagtcgagctccagcagcccgaccgtgggatgttgcagccgcaggcgactgttgcggcggacggcgacctcgtggcggtcccacacctcggcgaactcggcgctgctgtcccgcaggcgctggaccagggcggcggcggccgggtcggcgccgcgccgggcgacggcggcgcgcaggtcggcgacgtgcatgcggctgcagtagtcgtggtcctcctccgggatggaggcgcgcaggcgcccgtcgttgaaccagcgccacaccaggttgtggtcctgctcgtggtcgtgcgggccggccgggcagatgctgccgaacagggtctcggccagcgcgttctgtgcgagcaggtcgccgaggtcggtgacgatctgggccggggacatggtcagctggccgagcagggtgagcagcccgggccggacgtgattgccggcgagccgaccggcgggtgggcgttggccggcgagcagatagaggtggtcgcgctcgtcgtcgtcgagccgcaaggcgaaggcgagcgcgcgcaggacctggatggacggctgcggactgcgggcctgctccaggcgcatcagatagtcggcggacatgccggcgagcagggccagctcctcccggcgcagccccggaacgcggcggcgggggccggaggtgagcccggcatcctccggccggatgcgctcccggcagcggcggatgaagtcggcgagctcacgtcggtccatggcattcatcgttgctcgctcgtccggccgtagccaaggactgccagtcctagttagagcggtccgatcctcaacgcgtctccggcggtgcaaccttgccgcagacagcgaacgacagaggggtgctaccgatgcgagcgatcgttttccaggagttcggcggtcccgaggtgctgcgggtcacggaggccgatgttcccgagccgggcccgggccaggtgcggatccgggtccgcgcggccggggtgaatcagctcgaccacaagatccgcgagggggcgatggcgcaggtcttccccacgacgttcccggccacgccggggctggaggcggccggtgtcatcgacgcgaccggcgagggtgtcaccgggccggctcccggtgatgaggtgatcgcattcaccgataccggggcctacgcggagttcgccctggccaccgtcgtcgcgccgaaaccggccgggttgagctgggcggaggctgcggcactgccggtggccggggagaccgcgcagcgggtgctcggcctgctcggggtgaaagcaggcgagacgctgctgatccacggcgcgagcggcgcggtcggcggggtcgcggtgcagctcgcggtcgcgtccggggcgacggtcatcggtgtcgcctcaccggccaaccacgactacgtgcggtcgctgggcgccatcccggtggcctacggcgagggcctgatcgcgcgggtccgtgaggtggccccgcagggagtcgacgcggtcttcgacgcggccggctacggagcgctgcccgactccatcgacctggcgggtggttccaccgagcgcgtggtgaccatcgccgatccggccgcccgcaccctgggcgtcgtcttctcggccggcgcgcagaacacggtcgagggcctgaccgacctcgcccgtctggccggcacaggagcccttcgcctgaccgtggccgggacgtatccgctgtcggatgccgggcgcgcccaggtccagagcgccaccggccacacccgcggcaagctggtcatcgccgtccccgactgaggccgcggtcaaggagccgggcggctcggaggtggcgctcgcgatcagcatgaaccggtcgcggcggatggggcgtggccggagaccgtcccgcacgccgggcgtggccggagaccgtcccgcacgccgggcacgatccggtccggcgcgtcgtcgtcgcccccgagcggcggcgaatgcgggtcgaccgtgagctgcccgtgaaggccgcctaccgtgctggccgtctgcggcgccggcatgggcgcgaccattcccattgactaggtaaccacctactagctggtctttcaacgatttggttgacagccccacaggatcggcctacggttgctttcaaccggaaggttgaaatgaggggcggggatggcggtggatgggctgtcgcgggtgttcgcggcgctggcggatccgacacggcgggacatggtggttcggctcgcgggtggcgatgcgacggtcaatcagctcgccgagccgtaccggatgtcgctgcaagcggtctacaaacacctcaaggtgctggaggacgcagggctggtgagccggccgccggggccgcaaccgcggtcggtgcggctggagccggatgtgttcggcgaggtcggcgtgtggatcgagctgtatcggcggcgagccgaggaacgctaccgccggctcgactcggtgctgggcgccatggacgacaacgggcggccggatcgtcacgggcacggatcagacaggtcagagcgcgacgagcaggagggtggagcacaatgagcgaggcgaagatcgaggcggacgagaagctgccgatcatccggatcacgcgggacttcgcgggtacgccggagcagctgttccgggcgcacaccgacccggagttgttcgcgcagtggtgcgggccggattcgaccaccgcccggatcgagcagtgggatgcccgcgacggcgggtcctggcggtacgtggcggtccgcggggatgaggagtacgggttccgcggctgcttccacgaggtggggccgcgccggatcgtgcagacgttcaccttcgagggtgcgccggacggggtgtcgctggagacgctgaccttcgaggatctgggggacggccgcacccggctgcacgggcagtcgctggtggacagcttcgaggcccgggacgcctggctgcgcagcggcatggagacgggtgtcgccgagggctacgccaagctggacgccctgatcgccaagggcgccatctgaccggaaaggcgatcgggtccgccggcaccgggcggcctcggaaacggccaaccccgctccgaaggggcatgtctcagaagatcagccccgccccgggagggactctgttggcgaatccgccccgtcgcttaacaggggcggggcggacaaggctgacggcccgcccccaccccgcccagttgcctcccacggccgcgtagggaccacaccatgacgttgcgacacgcgattacgggtccacggcgcgcgctatcggcggcatgagcgtgcatcagaggtgatcaccagggcagttggccttcggcgtcgaagtagcctccggtgggcccgttcgggcctgtccgggccattcgtacgatgatttcggcgccctgcccgacggtctggcggccggtgttcttgttcaagtcagttttggtgaatcctggttcgaccgcgttgatccgcatgttcgggaatgccttggcgtattgcgcggtgatcatgttgactgcggtcttcgacgccggataggcgactcccgggtaggcgaatgccgcgtgaccgcgggtggtgacccgggtgagcgaggccagaccgctactgacgttgacgacgaccgggttggtggagcgctgcagcaacggcaggaacgcgtggaggacgcgcaccaggccgaagacgttcgtctcgaacgtctggcgcatcacctcggccgtcagctcggccgcgccgatcacgacgttgttctcactcagctccgcctgaatgccggcgttgttgatgagcacgtccagcccttcctcggcttcgacggtcttgacggcggcggccacggacgcgtcgtcggtgacgtcgagctggactgcccgggcgcccaactgctgggcggcccggcgtccgcgttcgatgtcgcgacttcctacatagacggtgtgtcctgcggcgatgagctggcgggcggtctcgaagccgagacccttattcgctccggagatcagcgttgcggtcatgaccagaacgctaggatttcgagcgtgctcgaagtcaagccggggccgacaccagaatccacgtcctccatcccgaccgtgggtgtgaccatcgccgaggccgcccgtcgcaccgggatcagcgtgcacaccctgcgctactacgaacgtgccggcctgatggtcgctgccattgaccgcaccgccgccggtcggcggcgctaccgccagttcgacctcgactggatcacggcctgtacaaagctgcgggccaccggcatgcctatcaagacgatccgtcgttacgctgagctggtctcctccggacacggcaacgagcaggaacgccttgccgtcctggaggcgcaccgcgcggaggtcgtcgccagactcgccgaggtgcaggaaagcctcactctcatcaatcataaaatcgatgtttatcgaggtcggctgaccgctggggttgccgagggactatgggcgtcccaccccgcgcaggcaggcgttgatctcgttgaacgtggttgacggcgccgggggccaccgagatggatgagggaagatcgacgcgctactttcggcatgatggtgcgccgttcagcacggaccagggcacacgcagcgtgatggctcgtcgggtgccgacgcggtcgtcgcggcagatccggatgccgatggacgtggcgattagtctttccggatgcctattttctactactggtaccagtgctggaaggcgtttccgggagagctgtaataccagagaccgaccgggctgccgtcgccgtgccacttggaggtaaacgcgtctacggcgaccgcgttgttggtcgcctgcgactccatcgcgacaccgccggacgcgttggtgaggtggaagttctggcccggcgcggaaccgtcccggcaatcgtatacattgaattgcgcaccgaccgtgtttcccatcgaggccggatagtccaggcagcgtccactcgcgttattgaccagctcgacgccgtaatagatgttttgattgaagatgcgccaccgccagagctccgtgcgaccgccattgcaggtccacaaacctaccggcgagttgttccggccctctccggaggcgaagttgtccaggcagtacccactcccgcgcccggccacgtgcaggttgaacggcgaggagtcggcgaccttcgtgccggtcaaggccatcgcccgccggagttccacgaaagcgaccgctgggtcggcggctgtggtggtcgcgtcaggagccgctgaggcaggacccgcgggtgccgccaccaccgcgcaactcgccacgagcacacaaagcttgagcttgagaatcaccgcatatcccttcatcgaggccgtcgacatcgtgcgtggcccaatcatcaaacacccgaaggccgccgcgctgaggtattcaccaacgcgatttcgcccggctgcccgatcaggttgggacccactacgtcctcgcgcatctcggcgcgctgatcgtcgcccggtctcagggtcgactcccacttgccagaagaatgcccatcttcgcgactcccggaacggtttaatggcggacgttgcacacctgaccaagctccaaagaagtcctagaatcaacctaattatcgtcctttggtaatggcagggtaaataccagaccaaacctcgactaactgagattccgcctcggtgtaacgcgctctcatcggcagttgagcacgttcgtaggatcggcgcgtcgacggctgatgcaactctcggttactcagagcagcctgctccgcctccccgagggcggccagctggcaccgtccgggtaggccgtctcagatcgtcaggccccgggcgcagggcggcgaagtgggacatgcgggttagtccgtgagggcggccgtcgagccacgcgccgatgcggttgacgttgatcgcggcgcctgtgaactggtgctgcagggacgtcttggccaggccgcggtagcgcgaccggcggaggttgaagctgcggacaccttgggagatggtggcctcgatgccggcccggggttggtagcggcgtttccactcggccgtggactggtcagctcgggccaactggagcgcttcgtgctcctcccgggggcgcagggtgaggttgcgggaacctgacgtggtgcattgactgcggaccgggcaaggctggcactgggttttcaggaaccggatccggctgacgggggttccgcgatggctggtcgcctctcgccagttcgtcgtggtctggccgccgggacaggttgcggtgcgggtatcccagtcgatggtgaaggcggacgggccgaacccgctgtcggccttacgcaccgtggaggcttgcaccgggccgatcagcgtgacgtcgtggtcacggcgggcggacaccagatgcgcgcgttgacgtagccggcgtcggccagatgcaccgagggcaacaggtcccgttgggcaaggtcgcggtggacctcagcgatcatgccggtgtccggggtggtggcgacggtggtggccacgtgggtaatcaggtggacctcgtcggggtcacaggtttcggtgaggtggaccttgtagcccgaccaggaggtatcccgcttgacggcgttacgcgcatcggtgtcgtaggggctggccaggcgcaccgcacccggcgggcagtccttcgggtgccgccacacgatccgctcctgtccgtcgtcggtagaggtgatggcgtactcctggacccaggtctgccgcaggacctctacggcctccacctggcgcaggtgcgcgggtgcgtcgccggcgaacaccgccgtcatcagccgggagccgtccgcgccgacctgttcggcaagcgcgatccgcttgcgggttcccggtgcgggcaggcggtactgctccgggcggtcgctgtagcggtcgaaccactccgcgtccgccagcgccgccacccaggtcggcgccagcaccgagagggcgttcagcgcggcgcgcatcgtctcgatacagcgttccagccggttgacctcgcgcaccgccgtgatcacgtgggtcgagtcggtgcgctgcttcccccccgcccttcaccaggccagtcgctcgggcggcgtcgactacggcagtgaatacggcctgctccaggccgccgttgatcaaccgggagcggaactccgagagcaccgagtagtcgaagcccgggtcggtcagctccaggccgaaggcgtacttccagtcgatgcgggcacgtacggcgtccgcggcctgccggtccgccaggccttcggcgaactgcaacaccgacaccaaggccaaccgggcaggagacagcgccggtttgccccgcgacgggaaagcgccgcggaacatgtcgtcagtgaagatcggcccgagggcgtcccgcacccgcatcgcggcagtcccggccgggaacgcggtccgggccacccgagcagtcagctccggaacctcacgcaggtccatcggacgcagcgacaccccaacctccacgacgaacgccccgaacatgatcagcagagatcatgccggggcgagcatctacttcggaattcgccaacagagtcccgggaggggcggggctcggcagaagcggagctcagcagaagcggggctcggcaggtgcggggctcagcaggggcggggctcggcaggggcgtcaggcgggagggccggcagggaagagtgagtcgaagaccgcggtgcggtcgaaggacatggcgtagtcgcgggcccggctctccatcgcccgtttctccgtttccggcatgtcgaggacgacccggtcgagggcttcggcgagcgcggtgatgtcgccggcctccacgatgatggcggtgtcgccgaccgcttcgccggtgccgccggtcagggtggtgacgatcgggccgccgccggccagcatcttctcggcgagggcgatgccgaaggtctcgacgaagtccggctccggcttggtgggcagagcgtaggcggcgcacccggccatcaggagtggcttctcgtcgtcgtcgacgtcgttgaggaagatgatccgctcgtcttccttggccatcgcccggacgtgttcgagggccgggccgttgccggcgacgaccagcggcacctcttcccggcactgcatctggccataggcgatgaccaggtcgtagatgcctttggcgcgggccacccgggacaggaacaggatgtacttgccgcgtttgaggccgcgcttctccaacgcctcgtcgatcgcgtcgtcgccgaggctgaggaaggccgacgagtcgatcggcgggtagctgactgtcacccggtcacggcactggctcgcgaagctggtgccgcagtgcgcgtcgacctcctcggccgaggcgatgatctcgtccttggtgtattcggagacggcgaccacctcgtcgctggccaggaaggtggtcatcagcacggtggccgcaccgaaccggccttcgcgcaggcacgagcggatcacgttcgtgacgtccgagccgaccgctttggcgatggtgtggacctgcgggttgaagccggcggcccgggccgcggtgaccgcgtcgttgatcacctgagtgtgcggaaccaggtacatcgacaggcagaccgtgggcacgccgtcgctgagcagttcgacgagccgaccggtgagtccggccaggtgccggccgtcgggcacccggtagtcgccgaccgcctccgggcgttcgacggtgatcccgtcgctgtacggcagcagccggtccagtggcttgagcggcaggccggccgcctgcagcgcggggatcggccaggtgagcaggcggacgtcgtcgaagccccggtgcagggcgacttcggcgaggttgcgagcctcaccggagtgtccgcagataaccgggtcggcgcggaccgcgatcacgagtctccgggtaggacggctcatggtcattccttaaagggggtgaaggagtgggacggcgggcggttcccgtgtccccacgtcgagggttcggggccgagcttgaggtgcagccggccgccgcggtgcacgtcggtcgccgagaggtgcgccgcgtgcaggggcttgccgttgagggtggccgattggacgtactgggcgggtgggtcccggtcgagaccgtcgacgccgatcggcgtgtcgacgtgtccgctcgtttcgatgatgaactcctcgtcgccgacccgcatcgcggcccgttcgaaggcgggggcgttcaccaggaagaggttctgcccggcgaccgggaacaggccgagcgacgcccagacgtaccaggcgctcaggccgccggagtcgtcgttgccgggcagcccgccgggaccggtaccgaactgccaggtcagcgcagagtgcacgacctcggcggtacggtcgggccggcccgcgtagtggtaggcccagggggcttccatgtccggctcgttgttcaggccttcgaaccggttgagcgcgtagccgagggccatctcggccggctgcgggctcacccccggctgtttgaccggttcggcgccgtagccgaagaatcggtccagtttgtcgatgaacccgcggtcgccgccggacagttcgatccgggcggccatgtcgtgcagcagccggaacgagtagttccacttgccgccctcgtagaactcggagtcccggagcagcccgctgaccgggtcgaacgcgttcacccactggtggctgcggcgttccaggtcgtcggcgagtctgcggtcgttgagggcgcgggcgagtttggcggtgcagtggtgggcgtacgccaggtcgagggtgtgcgtgatcgggtgcaccacgccgtgctcgaagaagtcttcgccgtacatccggcgcaggtcgtcgaccatgtggacgagtgcccagccccagtcgacgccgccccggccgagggcgtgcgcgtcggcgatcgcggtgtgcgccagcgcggacgcctgccggaagaaccggtcggcgccgcgcgccatccggtagccgatcgggaagttgccctcctcctcgcacacccggatcagggattcgagcaggtccatggcgcggtccggggcgatcgcctgcagcagcgggatctgcgtcttgtagatgtcccacatggtgcagatgtcgaacgcccacgggccggagctgggccagaacgggctctcgtcgtcggcgaagcacggcttgatcagggagtggtacagcgcggtgcccatcaccgtgcggcgcgcctcggtcccgccgtcgacccggacccggccgacgtggtcgcgccagcgctgcttcgtgctaaggcgcaccttctcgaaggccggctcgccggtgccacactcccggcgcagattctcccgggcctggtcgcagccgcgcagcgagaaacccatccggacctcgatggtctgcccggcccgggccgaccccatgaacagcatgccgaacgggcgcagcgtggtgtgccggatgctgtcgaagtcgagccgggtgccgcccgggatcagccgccggtcgtaccacagcatctgccgccagccgggggcgtcggcctccaggtggacggagagcggcacgccctccatcaccacggtgccctgcgcgcagccgtgccccatgctctccacctgggcgcgcagcgggaccgtgcggcccaggtcgatggcgaggccgccgcaggacaggtcgatcacgacccgggcactgtggtggtcggggaacgtgtaccggtggacggcgaccttctcccccacggtgatctcgcagcgcaccccggtgtcgaggttcgcggcgtagtacccgggctcggcgcgttcgtcgtgcagcgcccaggactggccaaggtcgtccagcggctggaccatcggggtgacccgcacgtagttgtagtacttgcggatcgcgccggtgccggactgctggaagtgggtgaagccggaggcctcggtgcgctcgaacatctcctcgggcacgccctcggtgttcttcgcgtaccggccgtaaccggtggggtaggcgcctgaataggcgcacgcgctgaccatgcccaggggcgaggtcgcgccggggtgggtgttgcccacctgcggcttgggccaccaccaggtggcggccagaccgagtgcgcggggcaggtcggtcgccgcggtgccgatgaagggatcaatgttgtcgaggatggcgggactctaaccggcgacagggcccgctgtggtttcaatcaggtgaactggaccttcggagtgacacacttccggttgatcaacatctcccggaacagctctcggcgcggcgggccgggtggggagggctgctcaggagcgaactgtgtccgccagagccgtgacgaatcgatcgatgtccgacacggtgctgcccagcccgaaactcgcccgcagcagcccggcaccgttcgtaccgcagatatcggatttctccgtgttggtgaggcggcggaccagggggtgcgcgcagaactggccggcgcggaccccgatgccgtgctcgcggccgagaaggtgggcgacccgggccggatcgtggccgggcagcaccagcgagacgatgccgacccgggggtgctcgggaccgaagatgctcacctcccggacttccgggacggcgaccaggccggcccgcagccgggccagcagcgcctgctcgtgccggtgcagctcgtcgcggtcggcgaccagcagcgcggcgcagaccgcggccagcgcggtcgcgcccagcaggttcggcgtgccgccctcgtgccgcgccggaccggccgcccaggtctgctcgccgggccgctcacccaccgtggcgctggccccgccgccgtagaggtacgggtcggcggcgtccagccagtccccccggccgaccagcacgccggagccgaacggggcgtacagcttgtgcccggagaacgccaggtagtcggcgcccagctcgtccaggtcgaccggccggtgcggggcgagctgggcggcgtcgacgaccacccggaccccgtaggtgtgcgccacgtcggccagctcgcgcaccggccagatctccccggtcacgttgctggccccggtgatcgccagcacggccggggtgcgcaggtcgcgcagcgcgttctgcagcgcctgcaccgcgaagtgcggcgacgccggggtgggcagccgcaacgggttcggccagggcagcaggttggcgtggtgctcgccgtcgaacaggatcgtggtggtgcccgcgggcagcgcccgggccagcaggttcagcgagtcggtggtgttccgggtgaagatcacgtggtcgccggggcgggcgccgacgaactcggccaccacgtcccgggccacctcgtaggcgaccgtcgaggtctgcgagcggaccccggtcccccggtgcacgctgccgtagcgcggcagcagctcgccgaccgcctgagcggcggcctcgacgcagggggccgaggcggcgtagtcgaggtgcgcgaaacggatcgtctcgccgctggggagctcggtcttcaggtcgtcgccgacgatgtcgagagccgacatggcatgcctccggttcagcgcttgccgtcgccggtcggcgaaacggcccggtcctcacccggggcaccccatcgcgaacaggaagggttgccggtcagcgagccggggcttgacgctgacactcatgacctgcccacgaagttagcagatgtcacagcgccgcgccatatcccacggagccagtagggattagggtcgacgcatgagcagcttcgagcagcagtggacccggtggcacgacgagcacgaaacccggcgggcggacaagcacggcttcctggcgatcaccgggttgcactggctgaccgagaccccgcagcggttcccggacgcacccggcgagtggagcaccggcccggagggcgtgctggtcaccctggcgcccggggaggagcttgacgggatcccggccggcgagcaccggttcccgcccctcgccgagcgcgccgaccacaccgtgggctggggcgaggcgaaactggagatcgcccgccggggtggtcacgacgtgctgcgcccgcggcaccccgcgcacgagaccctggtcgggtatcggggcacgccggcctacccgccggccgaggagtgggtggtgaccgggacgttcgtgccgttcgacgagccccggccggtgaccgtggggtcggtcgccgagggcctcgagcacgtgtacgagtcgcccggacgcatcgagttcaccgccgacgggcgggatctggcgttgaccgcgttcaacggtcacacgcccggctcgctgttcgtgctgttcaccgacgcgacgtcgggcgtcaccacgtacccggcgaaccgcagtgtggcgatcgcgccaccggccgccgacggcaccgtgaccctcgacttcaaccgggcgacgaacctgccgtgcgcgtacaccgagttcgccacctgcccgctgcccccggccgagaacaggctgccgatcgccgtggcggcgggcgagcagctgccgcgctaggttcggcgggatggaggagctgctcgcgccggccgaggcgctgatcgggatccggtcgaccgccgaccggcccgccgagctgcaccgggccctgggcctggtgctcgacctggtcggcccgggcttcaccacccggcgcttcgagtcccggggcaggcccagcgcgctgctcacccaccccgaccggccgggccggcctcgggtgatcctgaacggtcatctcgatgtggtgcccggaacgccgtcgcagttccgggcccgccgcgagggcgaccggctgtacgggcgcggtgcgcacgacatgaaggtcgcggcgctggtcctcgccacggtgttccgggaaatggccggggagctgccctacccgatcgcgttgcagctggtcaccgatgaggagacgggcggacaggacgggaccgggcaccagctggcgcagggggtgcgcggcgacttcgtgatcatcggggagcagagcgggctgcgggtggtcaccgagtcgaaaggcctggtgcgggcccggctgatcgcttccggcctgggggcgcatgcggcgtatccgtggctgggttccaacgccctgctgacgctgctgaccgcggtgcagcgactgatcgcgcgctatccggtgccggccgaggaggcgtggacgacgaccgccaatctggcgcggatcgagaccgggaaccaggcggtcaatcaggttccggcggatgcgacagcctggttcgacatccgctacccgccggaagacgcggcattgaccgggcgttccattccggagatcgccggtcacctgcggtcgatcgtgggcgccgaggtggaggttcaggtcgacgcggtggggacgccgcatcgggcggatccgtccggggccggggtgcgtgccctgcaggaggcggccaaggcggtcggatactccggggaactgctgcgcaagcacggggcggcggacagccggttctattttccgctcggcatcgatgccgtcattttcgggccgaccggcgacgggcagcacggcccgtcggaatacctggagatcagctcgctgcagccctaccacgacgcattgacgcgattccttcaatcccgctgaagagctcgtgcggcgagcagatgctcgatgcggccggcgatgccccgcaggtacggcccgcgttccgggtccaccagcgcgttcagtgagcacggcccgtgccgcagcagcacctcggcgtaccgggccgccgggtccacccgcagcccgctcggccccacggtctggtcggcgtaggtgagcgcgtccgccagcacggtccgctcgtccgggtaggcggccagcgatccgctcagcccccgcgccgcggccacgaaacgggccccggagtggtaggcgaccagcccggccacccggaccggccacccgttgcgggtcaggtggtcggcgccgtccagcgggtggaacccggtgacgacggtcggctcggcatagccgatgtcgtgcagccaggccgccgcggtgaccaggtcggcgtcgacgccgagcggcccggccagctcggcggcccgcccggcgaccccccgggtgtgcagccagcggtcacccatgccaccgagcagggactcggcgagcagccgggcggccgcggtcagcggacccggtgtggtcaccggacggagcagcgtgggggccgtcatcgccagagcgtaggccgccgatggtgaacagcggtcaaactccggcggaacgtgcggtcagcggcgaagctcaccgccgccagccccagcccgatcgcggccagcaccgcgccggtccacgccggtgccagatagccgtaaccgcgcgcgatcaccagcccgcccagcgccgcccccaggccgttggcggtgttcatcgccgactggttcaccgccgcgcccatcagctgggcccccggcgccaccgcgatcagccgggcctgcatggccgggcccagcgccaggctcgccgcgcccaccaggaacgacccgaggaacaacccgaccgtgctgtgcgcggtcaacgcgaagatcaccgccgccacgatcaccgtgctgaacgcggtcagcgtcgcccggcgcaggttgcggtcggcgaaccagccgcccaccgcgttacccacggtcatccccagcccgaccgcgaccagcgcccacggcaccgcgcgggtggacaacccggtcacctcggtggtcaccggggcgatgtagctgtccaccgcgaagaacccgccgaacccgaccgccgcggtgaccgccaccagccacacctgcggccggcgcaacgcccgcaactcggcgccgatcgacgcgcccgcgggcgtcggcgtctgcggcaccgtggccagcaccgcgaacagcgccagcaggaacaccccggcgatcaccaggtaggccacccgccagccggacgactgcccgatcagggtgatcaccggaacaccggcgacattggacagcgtcaggccgccgagcaccacggcgaacccgcgcgcctcgttgcccgggcccatcaggttcgccgcgaccagcccggccgccccgaaatacgctccgtgcggcagcgccgcgacgaaccgggcgacgagcaccagcccgaacgtcggcgccagcgcggacgccaccgtacccaccgtgaacagtgcgagcagacccagcaccagccgcttgcgcggcatccgggcggacagggcggcgatcagcggggcgccggccaccaccccgagggcgtacgtggtgatcacccacccggcctgcgccaccgcgtcctcgtgcgagcgcgcccacgcggccggcagcagatcgcgggtcatctccggcagcagccccatcgccacgaactcggtcaaaccgatcgccacgccgccgagcgccagcgccaccagcgcggtcccccgctgccgtccggtcacatgatccattcgcatgaccctaggtcgctccccgcccgccggcagcgtcgcacttcacaagacgatggcggggtacgacatcagccgcgaaccgccgcgacgacgaccatccgccggtgttccgccgagagtggctcgccgtcctcgccgtgcccggccaccgtggtgcacccggccgcggcacaccagtcccggatctccgggaaaccgaacaggcgcttgacgaaggtcagggtgcgcgcccggccgtcgcggaccacggtgcgctcgacctcgaagcgtccggtgagcgggtcgaagcggtgccggtcggcgagcagatcgccgttaccgagggcgacggtgatccgggacggcgtccacgaggtcaggaaccgcacctgattgtcgaggtccaacgccagccggccaccggggcgcagcacccggacgatctcgtcgagcacgtgccggttgacggcgtcgtcgaaatagccgaacgcggtcgaccagttcaccacccggtcgaagcggccggtccactcccgcggcagctcgcgcatgtcaccggggacatagtcgatgtcgagggcgcgggcggcggcgtcggaccgggcccgggccaggaagacctcggagaagtcgaggccggtgacccggcagccgcgggccgcgagggcggcggccagagagccgtggccgcaggccaggtccaggacggtcatgccgggtgccaggccgagcagccgccacaccacgtcggcggtggccggcccgccgcccgcggccggcacggcgggcccgtgcgtcacccccgccgccgcccgacccgcctcctccgccgggtgcctggcgaagaagtgcaggtagtcgtcgtcgtacatggccgaggcatcgaagaggtccgctgtcatgggtcgacgctagaccacccggccagcggcgaaccagaacggcatcacctcgcacccgaacggcactgaacgctttcgttgaccggtccgtcgcgccgccgaactgaaccggcacatccacccgccgtcacgaaggacctggccgccatgcgctccgtcacccccgtcgtcgcccgttccctgccgctgctgctggcggccggggcgacggtctcgtcagcgacgaccccggcgtccgccgccaccgcggcggtcaagccggcggcggcgatcctggcctccacgaccgtgccgggcgcgcgggacagcctcaccccggcccagcggctcgccgcggtccagtccgccaagcagatcaactactacccggcgggtggcagctggacccggatgtggaccgacttcgacgccaagaagatcgacgccgacctggccaaggcccgggcactcggtgcggacagcgtgcgcgccatcgtgttcccgtcggccttcggctaccccaccccgaaaccggagtacgccgcgaagctggcccagttcgtgtcgctcgccgcggcccggggcatgaccgtcaaggtcaccctgttcgactggtgggacggctactccgacgtggccggcagcaccacctgggcgaacgcgctgctcgccccgttccgtaacgacgaccggatcatttcgatcgaactgcagaacgagctcgacccgaccgacccggccgcgatcggctgggcgaagaagctcctgccggtgattcgcaaggccgtgccgggggttccggtgaccatcccgatcagctcgtcggccggcgtcgccggcctgtccacgctgaagtcggcgatggcggcgacgccgctggactactacgacttccacctgtacggcaattcggaacgcgccctggcctcgatccggcaggcccaggccgccgtggcgccggccccgctggtgatcggcgagaccggtacgaacacgctgcagtccagcgagggtgagcaggccgcatatctcgcccgggtgttcgccgccgccgaggtggccggggtgaacgcggtcgcgccgtggacgctgaacgacttcgccgccggcagcatcccggactccggcgtcgcgcggatccccgagcagtactggtacggcctgtaccgcgccgacagcaccgccaagccggccgccgcggtggccaaggccgagtggaacggcgcgccgtccccgaccggcctgatggacctcggcttcgagaacgccgccggtcagacgccgtggcggtcctacctgtccgacctcggcacgcccacccggacgcagacggccgcgcggtccggcaagtggtcggtgatgctgaccaacaccggcaagacggcggccgggtcaccgtcgtaccgggtgtcgccgatcgagccggtgcagcccgggcggcggtggcacgccgaggtctgggtccgcggcaagaacgagaccggctcgacgcagatcgcgctgagctggttcgacgtgaacgaccgctggatcggcggcgcctcctccgccgacctgccgtccgggaccaccgactggacccggctgtcggtcgacggtgtggctcccgcgggcgcggccagcctgcaggtgcacctgaagtcgggggccgacaccggcacggtctggttcgacgacgtggcgatcagcgcctcctgaaaccgggcgattcgcaactgtgctgcagcccggtgcgtctcacgcaccgggcccggccgccgaatctgagggcatgattcgtagacggcgtcagggtagcgatcggctcggcggctcccgcgaagcgacgggccagcggtggacggccgggcgggtgtcggccgccggctacgggtcggtcatcgggctgctggccctcggcggtgccgccgcccacctgggcatcgacggcgcgcaggcgcagcgggcgccgatcgaccgggcctatcaggcgctggacaccctgtcgagcctgcggagccagctgcaggacgcgcagcgcggcgaacgcggcttcgtgctgaccgccgacgagcactacctcgcgccctacacctcggcggcgacccaggtgccgcaaagcctggcgcggctgcgtcagctgctcggcgccgacaccgcgcaccgacagacgctcgacgatctgcaggcctcggccaccgccacggtcgactacctcggtctggcggtcacccagctgcgcgacgagggtttccgggacgcccggccggacgtgctcggcaccgccggcaccgagacgctggatcgtgccggccggttcatcgacaccctgcgccaggatcagctgaccgtgctgcacgcccggcagcagcagcaacaggagcaggaatcccgggcgctctggctggtcaccgcggcgctgggggccgcctcggcgatcgcgctgaccgcctggcgggccacccgatcgccggccccgtcgccgccggccgagcccgctgcggcggtcgagacgttctcggcatccgactcggcttcggagcccgccgaggagacctggcacacgccgctgcgggtgctgctggccgaggacgacccggtcaaccagaaggtcgcccagttcatgctcggcaaactcggccaccgcgtcgacaccgtcggcaacggtctggaagccgtccaggcgctgcgtgccgccgactacgacgtggtactcatggacgtgcagatgccgatcctcgacggcctcgaggccacccgcctgatccgctcggagttcccggccgaccggcagccgcacatcatcgccatgaccgccagcgtgctggccgaggaccgggccgcgtgccgcgcctccggcatgaacgactacctgcccaagccggtcaaccttcccgacctgaccagcgcgctgaccccgctgctggacctcggccatgacctgcccggcgacgacggcgaatccggcgatgcccggaccgcgcccgacgccgaccgggagtcggaggtccgcgcccgcctggacgacatcagcgacggcgcacccagcgacccggaacggaccctgctggcccgcctgctgcgctcgttcaccaccggcaccccggccggcatcgaccggctcgccgcgctgtttaccgccggcgacgtccccggggtccgcgcccaggcgcacaccctcaacggctccgcctccaacatcggcgccgtccacctggccggcatgttcgccgcggtggaggccgacgcccgcgccggccgcctcccccggaatgcggccaccatggccgccatccgcgccgagtacgccgccgtcgtcccggtctgcgaacgcctcgccgacgagctgtccgctgccacggcccactgaccgccaccaccgccccggcccgcctccgtgcgcggccggggcatcccgggcgtgcgtgtcacgggcagcgcctccccgacccgggtcaacgccccccgtcgaagaccccggcgacctgcgcgatcggacggcggttgccgtcgcatccccgaaccgttcgacggtgggcacctcgccggccagccagcgcgccaccgtccgacgatcgaacggacgccgcgcaccgcccgaccacacatgtgacgatcgaacggacaccctgcaccgcttcaccacacggtcgatgctcgaacgagcagatctgcgctgcctgatcacggtggacggtggccggacgagcggaggggcaccggcggtccggcggcggggcggcggtcgtgcgcggccgcgatgggcggaccacgtcttggtccgccccaccccggatggtcgctcagcgatcgggagtggcagcggcgtcgcgccgcgcggcggggccgtgcacaggtcgtaccaccaaagatcttggccgttgatgatcagcggtccggaagcgtgaagatgatcttcgtcccgccgccctcgttgtcggtgacatggatcgtgccgccgtgccggtcgacgatgcgcaggcagctggagaggccgatgccgtgaccggacgccgaggtgccgtccaggcgggtgaacatgtcgaagactcggcggcgctggtccggggggatgccgctgccgttgtcggcgaccgttaccgcccaggcctcttccgcgcgggcggcggtgatgacgatgcacggccggcggtcggggtggcggtatttgatcgcgttggcgatcaggttctgcaggagctggcgggccaggaccgggtcgcaggacacgacgggcaggtgggccggcgagaggatccgggcgccggaggcgagtatttcggcgttcaggtcggcgatcacactggtgaggatgtcgccgaggtcggacggggtgcggcggatgggggcgctgccggcacgggcgtaatcgaggagggagccgatcaggtcgcgcatccgggtgacggcgcgggaggcggcgtcgacccagtcgcggggctggccggtgacgacgtcttcgagcagctccaggtagccgccgacggcggcgagcggagcgaccaggtcgtggctgaccgcgccggcgaagttggtcaggtcggcgttggagcggcgcagctcctcgttggcggcggcgagttcgcggcgggcgtgttcgatggcgcgctgctgggcacggtcggtggtgacgtcgttcatcgcgacgaccgcgccgagcgggatgccgtccgggccgaccagggcgcggccgttgacggtgacgtggaccgggtcgccgccgcggcgccggatgagcatttcggcgttgctgaccgaaccctcgtgcagagcgcgcagcagcgggacccggtcggccggcagcggcgtctccccgtcgatgtcgaacaggaagtaccggtcggcgaagtcgttcgggtcgacccccgggtcggcgtccaggccgtgccagtcgcgggcggcacggttgaacagggtgagccggccgtcccggtcgcaggcgaccacggcgacgtcgatcgtctccagcagcgtgtcggtccaccgctgccgggcctcggcgatcgcggccaactcggcgttgagccgggcctgccggcggcgctcgaagagtgccacgatcacgtcggcgaggtccttgagccgggcgatctgctcgtcgtccagctcggccggctcggagtcgaagacgcacaacgacccgagcgcgtagccgtccggggtgaccaggggcgccgacgcgtagaaccggaccttcgcgtggacgccggtcacccagggattggcccggtacgtcggatccaggctggcgtccgggagataggtgaattcgccggtctgaaaacggatcgcgcacatcgactcggagcgcggcgagtcgccgccgtcgaacccgaccgtggtcagctggcactgccggttctcgtcgatcaggttcagcgtggcggtcggcacccgggcgaccgtggccgcgacccggacgaccgcctccagctcgttccccgccggcgagtcgagcagacgatactcgtggagcgcggcgagtcgccgctgctcccgatcatccagcagcacgcccatcctatcggcgtccccgggccggtcctgaagggcgcgcccggtcggccagcgctccggcgagcagaccgtcgatcacgtcgcgcatccgggtcacctcggccgaaccggcggccgcctccggacaaccctccatcgccagcagttccaggaagccgccgaccgcggcgagcggcgcgatcaggtcgtggccgaccgcggcggcgaagttggtcagatccgcgttggaacgttccagctcggcgttcgcggcggccagccgttcccgggcctcctcgatcaaccggcggcgacgtcggtcggcggtcacgtcggcctgggccagcaccgcgccctggatctccccggccgggccgcgcagcggaccggcgttgacccgtacgtgcaccggctcgcccaccggccggcggatcatcatctcccggccggtcaccgtgatcccccgacgcagggcgatctgcagcggcagttcgtcgtccgggatcgtggtgacgccgtccggctcgaacaggccgaaccgccgggccacgtcggtgccccgcgggtcgccctcgccgctgcgaccgtgccattcgcgggcggccctgttccagagggtcaccttctcactcgcgtcgcaggcgatcaccgccgtgtcgatcgtctccagcagcgtgtcggtccaccgctgccgggcctgcaccgtcgcggcgagctcggcggtctcccgcgcctgccggcgccgttcgaagaacgcgaccacgatcgcggccaggtcggtgatctgcgcccgctcctcggggcgcaggtgatgcggcacgctgtcggtcacacagagcgtgccgagcgcgtgcccggccggcgtgatcagcggcgcggcggcgtagaaccggatgtccccgagtaccccggtcacccacgggttgttccggtacaccgggtcgagccgggcgtccggcacgtgcgtgaagcggccggactcgacggtgaccgcgcacatcgagtcgtcccgggcgcactggaccggcgcccggctcagggtgacgagctggaactgcgaccgctcgtcgatcaggttcaggctggcccagggcaccccggcgatcgtcgcggcgacccgcagcacggcctgcagctcctcccccggcggggtgtcccgcagccggtactcgtgcagcgccgcgagacgctcctgctccacccttacctgttcgtccggtccgacccgctgctgagcgtcccctgtgatcgacaatcagcgataggatcccgcgatggacttcctgaagcccttcgttctgcccgtcggcgaccagtctccggaacgccacgagttccacgatctctacctgcccggcgagatcgccgcgccacgcccggcgatcctgatcgttccgggcggccccctgccggccgaggttcgcccgacgcagcgggattggcccgttttccaggggtacgcccggctcgccgcccgccgcgggatgatcggagcggtcgtcgagcaccgcctctacagccccgccgagtatgcgaccggcgccgccaacgtggcggccgtcgtggagaccctgcgcagcgatccgcgggtcgacgagaatcggttggcgatctggctctactcgggttcggccctgttcgccgcggactggctgcgcgaaccgccgtcctggctgcgggtgctggcgatgagctatccggtggtggaggccttcccgggatggccggccgacgagcggttcacgccggtggcggcggtggccgaggccggggacctgccgatcgtgctgacccgggtcggcagggaacagccgatcatcgccgggccggtgaaccggttcgtggaggcggcggtcgcgagcaaggccgacctggagatcatcgacctgccggacggccagcacaccttcgacgccaaggacgacaacgacgagtcccgggcggcgatcaaccgggcgatggacctggtcaccgccaagctggcctgacccggttgcccgccgggagcgccgccgccgtcggcagcggtgctcccggtcccgcctcagtcgtccgtcaccgggtaggtgatcgcgatgccgtcgccgtgatcgtcgaagcggtccgtggccttctcctgatccgatccgtctccggcggtccggtggtcccgatcgccggtggccgccgggtcgtcgccggtggaccgtcgggcgtcggcgtcgtcggccgccgcgctcgtctccgccctggtgaccgcgtcgttccggaccgcggcggctttcgcccggcgcttcggacgggacggcttgtcgcagtcgcgggacgcgtggcggcccaggtcgtcgccgctccagccgttcgccgcggcccggaggtcaccgaggtcgcgggcgtcaccggtggtccagcggtcgccgccgtcccagtcgccgccatcggtgtccccgttgccccagccgccgtcggcgtcaccgttgccccagccgccatcggtgttcccgtcgtcccagccgccgcggcggtgaccgacgcccccaccggcgccccggtgcccgccggcccagcggtcgtcgccgaatccgtgcgagtcgaacgggaacgcgtcatggttgatccgggccagcaggtcatcgtggaaccgccgcatccggccgtaatcgtcgtccgcctgcggcagggcgaccggcatgccggagtgcgtcaacaggtagatctgcgagtcggtgtccccgcagacctgcgagttgtcccaccacccgttggttagggtgatgtcggtgatgccgccgtggaagcgatcacagctacggttcgccgagatcggccggtccaggtcgcgcacccaggtcggccggctggcccggaccgcgcggtgctggcccgacggccgggcgtgcgtcgccgggcgcgcgtgggtcaccggccggtcgctgtgaacgtttccggacgagtgatggctggtggccgggggttcgacggccggcgggcggtggttgacgatcggctggacgatcaccgggccgccgacgaccggggtcgccgggccggtggccgggtggccgttctggcccgtgccggactggcccgggtggccgggctggcccgggtggccgggctgctggccgatcggatggctgatcggctggccgacggggccttggccgggggcgtgctggccgccgggctgggctgccggggcgccgccgccgggatgggcggatcccggctgtgcggcgccggggtggcctgcacctgtctggcctgcaccggtctgacccccgccggtctggcccgcaccggtctggcctgcgcccggctggcccgcaccggtctgacctgcgcccggctggcctaggcccggctgacccgctccaggtaggccggttcctggctgacctgggccaggctgacccacgccgggcacgccgccgactcccggagccgctacattgcccggatttttggggttattggtggatgagttggtgccaccgagaccggggccgccgacaccggtgccgcccggccccagcggcgggttctggacgacggtgccgccgaccccgagtccaccgccgtgcccgtgcacccccggcgtggccaccacggtgccgcccgggccgagcgcccgaccgccgtcgcctcccgcaccctgatcgattccggacgacgacccgccggcagccgtgccgatcccgccggatccggcgcccgcctgaccgacgttcccgtcctgctgctgggcgttcgtcgtcggctcctggctgccgtcgaccgttccgggctccgccgggtcgagcgtctcccaggtcgcgccgggcggcggcagctcacccgcgaacggcttctcgtcatcgccggtgcatccggcgacggtcatcaacagggccgcccccagcgcggcaccgatccggcgcgggcgtacggacatgttgtcggcgctctgcatgagtggtccactccccctccgtggacgccatgatcagcatccgggcggggttcactatccaccgtccagccccgacggtcgccaccctggatcttcgacacacccaccgcgcgggaccttccagccccccgggtgaccagtcgacatgcccggcccgcccgctcgttaaccggcggtcaccaccaccagcaccgccgccggccccgctccgcccgcatccgccccgccttccacgaacaccggcgccggccccgctccgcccgcatccgccccgccttccacgaacaccggcgccggccccactccgcccgcatccgccccgccttccacgaacaccggcgccggccccactccgcccgcatccgccccgccttccacgagcaccggcgccggcccgcggctcaccgaggccggcctcgccgcccggccacaccaggatcaacagcagaatggaccggcgtccgccattccctctcaccgagcccgggtgccggggcggattccaacggtcagcgatgccagcgcaggggtccagggtggacagtccaccagattttccgccaccatgactgccgctcgcgcagcgccgccgcatatgccagcacctgcgccccggcccggtccgcctgcccggcggcggccgccccgggcgcgaacccgaccgtgttcaccgcatccaccagcgcatccaacggcggaagcggcggaagcggcggctgcgcgcccgcgtcgcccacctccaccgactccgcggcctgagcgggtgaaggcaccgacgaaggggaggacgagccggccgcggtcgccgaagccgaggccgacgaggccgaggccgacgacgccgaggtggaagccgcgaccgaccacgccgaggtggaagccgcgaccgacgacgccgaggtggaggccgacgacaagctcggccccaccggggacgccgagggtgagcgcgacgccgacgaagccggcgcggccgacatggaggacgggcgggacggggcgacgggggtggcgcggcgcagcagagcggtgcggcgcgcggcgggcggcgccgccgcgtacgccgccatctcggtggccgaaagatgacccggcaccggttgcccggccagccgcaacgcgtcggtgaactcccgccacgccccggtgatccgctggtcgggactgcccttcccgagccgccgcagccgcagcccccgccgcagtcgcatcacggtcagcccggccgccatcagcaccagcagcaccgacccggacgccgcgccggccaccacggggccggacagcccgccgccgggccgcaccgccgcggccgccgccggtgtcgacggcggcgcgctgccggtcgacgtgtcggtctgcggcggtgtcgtcggcggcgtggtcggtttcggcgtgaagtcctcctccaccggtctcgggtcgtcgctggtcggcatcgggtcgaagggcacccagccgagcccgtcgaagagcacttcgggccaggcgatcgcatccccgccggtgacctggccgcccttggcgggcgcgtcgaagccgaccaccacgcggctgggcagcccggtcaggcgggcgagcagcgcgaacgacgccgcgaactgttcggaggtgccctcctggccgccccgtccgcgcggcccgaacaggaagtacgccaggttcgggtaggcgtgcccgctcggcgcgtccggagtctcccggtagtgcccggcgaggaactgttcgatcgcactggcccggtcgaacgccccgccgttgccgtccgcgaggtgttcggcgagtttctggatcgggtcgggcaccccgtcgccgacggtcaggtagcgcaccacggcgtcgccggccggcgcctcggcggtcggcagcaggttcaggtcgggggtcggcacctcggacgtggcggtgtaggtcagcccgctggtcagcccctccggccggatcatcgtgccggtgccggcgtcgaacgcgacccgcgccccggagagttcggccggggtggccaccgcgggcagcagccgcccggtcagcccggcgatggtgatccgctgccgcagctcggtgacgtcggtgccgggcggacgggtcgactcgggcagcacccggccggcgttgcggtagagcgcgccgaccttccaggtcaccccgtcgtagtcggagaggaccgcgagccgcacccgcaccgtggtcgccctaccggccggcgggctggccggttgatacgtgaaaagctgctgtcccggggcgagcatccagccggagatccggttgagcgggctctcgtcgaggctgtccacctggggtggttcgacgtagcggcgcgggtcgaccgggtcgccgccgacctgaccgctgatccacgggccgacgaccgcggccaggccgacgaccgcgaccaggcccacggcggcggcgccgagcgaccgcgcacgcacggcggcgggcagatcggcggcggccggatcgcggtccacggacaccgcgagcgcggccaccaccagggcgaccacgccgagggtgggtgccacggccgggccggcgttcggcccgaccacgtacagggcacccgcgtacaggcacatcggggtgagcgtgcccagcagcacgcgccgcgcccgcacgccgacctcgaccgcggccatcccggcgagccacgtggccacgaccggcacgaccacggtgtccggtgtggactccaccggaatcagggcggtaagcagccgcgggatgccgttcaccagggcgtcccggacgatcgacgggaacggggtggtcagtccggcatgcccggcggcgagtttcagcgcgagcgccgtgtaggtggccagcagcaccgcggagaccggcgcggcgctccaggacggcagccggcgggtggccaccccggccccgatcgagccgatcgcggcgccggcgaccagccggaacagcaggtcgtcggcgtagatccggccgagcgtcagcccggccagcgcaagcatcccggccagcgcgagcggcaccacgacgagacgcggccatctcaccatccgcgtacaccgtcccaggccgcggcgaactcggcgccgtcggcggcctcgatcacgatcaggcggtcgccggccgggaccggcgccgcgtcgcggtcgccgaggatcgcggcgaggatcacggggtacgtgcccttgagcgagctgacggcgccgaggtcggtccggccgcccggtccggtcaggaagaccagggtgtcgccgaggcgctgggcgcgcatccgccggaccgtcgccgtcagatcgccggggcggggctgcacctcggtcagcacgtccaggtacggcccggtcgccacggtggtgaccaggtgcaggccgaccgggaggtcctcgcggacggcggccgcgacgatcgacgcggccgcctcgcaggccgactcgaacgcctccggatcggggtaggcggtgtcccggtcgtcgagcagcactacgatcgtcggctcggccgtgtccagctgctcgcggaccatcagctcgccgaccttggcggagctgcgccagtgcacccggcgcagctcgtcgccgatcacgtattcgcgcagcgcgtcgaaggtgatcgtgccctgcggcaccttgtcgatccggccgtcgaggctgcgggccatcccggccggggtggcccgcagcaggtggatccgcggatgcacccagacggtggccacctcgccgtacgtccgggccagccggaccaggccgagcgggtcgccgcgggtgatccgcagcgggccgatcgggacgatgccgcggcgcccggtcggcaccgggtactccgcggtggtgtcggcgccgggaagcaggcgcagcagcggaaccgggacgctcgtgccgccgcaccggtcggtggcgatcatgctggccgcccggaaccggctggtgttgccgaccgtgagccgcatccgggcggcgtcgccgcgggccacccggtcgggctcggcgacccggtgcacgcggagccggggccgccagaaggcgaaggcgagcgcgcccgcggcggcgaccaggccggccgcgccgagcagggcgagatccggatagtggtagccgaagcccgcggcgagcaggaccgccgccgcggccagcaggccgatgccgcgagcggtcacgcgctggccgggagcgggacgtgcaccgtgttcaccgcgtcggcgagcacgtcggtggcggtgacaccgcgcagctgggcgtcggcggacagcagcacgcggtgggcgaacaccggctcgaccagggctttcaggtcctcggggagcacgtagccgcggccgttgatcagggcgtaggcgcacgcggcgcgggtcagggcgatcaccccgcgcgggctgacaccgacccggacctgcgggtggttgcgggtcgcggcggccagacgcacggcgtacgcgtacagcgggtcggcgacgtggacctgcagcgccattttgaccatctcgccgatcgtgccggtgtcggtgaccggttccagtgcgtccggcgaccggcccgccgcgccgcgcagcacctcgatctcgacgtcctcgtccgggtaaccgaccgacagtttgaccaggaaccggtcgagctgcgcctcggggagacggtaggtgccgtccatctcgaccgggttctgggtggcgaccaccaggaacggccgcggcaccgggtgcgggtggccgtcgaccgtcacccggcgctcctccatcacctcgagcagcgcggactgcgtcttcggcgaggcgcggttgatctcgtcggcgatcacgatgttggcgaacaccgggccggggtggaactcgaaggcccggctcgcctggttgaagatcgtcacgccggagacgtcggagggcagcaggtcgggggtgaactggatgcgccgccactgcccgcggatggatgcagcgacggcgcgcgccagggtggtcttgcccaccccgggcacgtcctccagcagcacgtgcccctgggcgaacagcgcggtcagggccagccggaccacctccggcttgcccagcacgaccgtgccgatccgctcggcgagctgcccggccacctgggcgaagccggacacgtacgacgggggcagcggttcggaagtcaccagtcggtcctcatctagcagttcggcaggttgcccaggtcgtcgccgccgtccaggttcagccaggcccaggggatgtacgtcttccccttgtagtcgatctggatccaccaggtgctgcgcttgttgttgttgtagacgaacgcatacacctcctcgcccgacttcttgcagtacgtcttcaaccgggtcccgttcggcacccatccggcctgttgcgcgtcgttctgcctggtgaccgtgaagatctcgttgccgttgcggccgtcgacgtcggcgttgcagtacgtcttctggtcgccggtggaaccgttgatgcaggtggccgtcccgtacaggtcggcggtggccttggtggcctgcttggtgaccgtgccggccgcgttcttcaccgtcaccgtgaacgtgtagtcggtgcccggcttcaacccgctcgccttgaggctgctgcagctgccgccggagccggtgccgccggacaccgcgagggagcaggccgcggtgccgccaccggcgttcacgctgaacccgacggtcgccgcgttgaacgtggtggtggtgccggtgatggtgaccgtcggggcggcgaccgtgcgggcggtggccgacgccggatcgcccgggccggcctcgttgaccgcgaccacctgcacggcgaccgtctcgccggcgccgaacccggtgagcgtggccgcagtgccgtcggcgacgtcggtgctccggccgccggcggtcaccacgtacctactgatcgggcggccgttgtcggccggggcggcccaggtgacccggatcgcgccgggctggtcggcgacggtggcggcgtccaggttgtccggcttgccgggcttgctgaacggcaccacgctgttgctgatcgccgacgacttcgacccggcgccgtgctcgttgaccgagacgacggtgaacgcgtactgcttgccgaagtcgagctgaccggccgggatgctgatcgaggtgtccttggcgtcaccgaccggggcggtgccaccctcggagaccgcggtcaccgtgtaccggtcgatggccaggccctgcccgttcgccgcgggccaggtcacggtcaccgagccgtcgggtttcgccgcggcctgcggggtgcccggcgggtcgggcacctccgaggtcggcttcaccgggttgctggagcggtccggcccgtcgcccttggcgttgaccgcgtgcacctggaaggtgtacgtctcgccgttggtcaggccggtcaccgtgtaggcccgctgctcggcgccaacggtgaaagtctggttgttgccgctcaccacgtacttcgcgatggcggcgccgttgtccggcgcggcctgccaggtgacccgggcctcggcgttgccggccgcggcccgcacgttgcgcggcgcgcccggcttggtgaccgccggcttgaccggcttcttccgtggcggggtcggcggggtggtcaccttcggcggggtgccgccggggacgtcgtcggcatacttgtcgaccgggcggacgccgtgctggttgtcgaccacctgggcgatcgacgaaccgggggcgttgatgaacaggtagccctcccgcacgtcgagctccagcgagccgcccggatgctggaagacgatcggtttctgctcctggccggcctggtcgaagacgtgcaccgtgccgccgtcggcatccgcgacgtagtagaagccctcccaggagacggcgggctgcaactgcgactgcgtgccgcccccgcgcacggtgaacgtggccttgatcccgccccgcgggtccaccccgaccacctggcgggtgtccggcacggtcaccgcgaccgtgccgccgtcggtgtgcgcggccagcgtgcccggcccggtcagtggcagcgtcgcgtgcgtggtcggcgtgtcaccgacccggaccagctcgttcgtcgtgcggtcgaggaccgcgacgccgtcgtccagagtggtcaccttgaagtcgtggctggcgccgccgaccgtctcggtccgcacccgctgcgcctgggcggcggtgccggcgccggcccgcggcgccggggtgatctcgatgacggtgccctcgctgggcgccaccacccacagccggccccggccgtcgaactgcccgccggtgatccccggcggcagggtgatcggctgcccgatgccctgcaggctggccgggtcgacctgctgcaccctgccctgcaccgaatccacgatgaaggcggtgtcgttgtgcagtgccacactcacgccgacgcccggcgcggcccgctgattccagtacgtctgcaggtcggtgaggtccatcgagccgatcgcgccggtgttgacatcccgcaggatcacgaagcggtcactctgggttacttccaacccgtgcccgcgcgcctgacccacatccacccgggtgtcgatcctggcggtcaccccgttgacccgggacatctcgcccttggcccggctccacacccaggaggcggcgtcgaagctggccaccgccttgtcggcctgcccgaggccgagcaccgtcagcccgaggccaccggccagcgccagcaccgtacccatcgtgaccaggtagccacgactcggtaaccggcgcttggacgcgccgtctgcgctgctcaccgcgggtgtcctccccgttcgcgaaggtgtgcgtgtcaaggacgctggccatcatagggggatcgcggcgggcgtcgatacccagcgttcccgcctgtggacaacgagctagatcatttcttgccgcgctcggtgcacacctgtggcgaactggcgaacttgtcggtcgcataaacggccaccaccgcgaagcagtagtcaagtgacgcattcagcccgtcgatccaccgggtggtcaccccgggccccaccgtgctgaccggtttcaactgctcacccgggtgcgccatggtcaccatgaaactcaccgaggcgttcgacgggtcggtccagccgaccaggatcctggtaccccgatcggccagcttcacattgcccggcggcgcgccggtcagcgtcggcgcacccggctgaccatggtcgtcgtcacccttgcgggtctgctgcgccagggtgaaaaccatcgcgcccacggcgacgaccgccgcgatggtcgcggcgatcaccgcgaacagggccatcccccgcttgcggtttcccccactgtcgtacgccgtgacctccgccgccgcgccccccgtcaccggcgtagccgggccgccctgccacacgccgtccgcaccctggtgatagaccccgccgcccggcatctgcgccggatacaccccgggttgcacggcccgctgcggaaacgcctccagcgcccccgcttcccactgccccgcctcgcgctgagcctcccgctgccccgcctcgcgctgagcctcgcgctgccccgcctcgcgctgccccgcctcgcgctgcccggccccgctctgccccgcgtcccatggtgtcggctcgggcagggcgatctcctgctggtagccgctcgaaggcacgtccggccgggcggagccgccctgcgggccggcctcttgcgggtggccggtcgccggccacacggcctgcgcggcctgctgatccggccgctggaccggaggcagcggggccgggacgtgctggatctccggctggccactccacggcgtagggccaccggcctgctccggccagccgttgaaatccggccaggcggtgaggttttcacttcccccgggaccggcaccatcccgcgccgcccgatgggccgcctccgtctcgcgcgctgcctgccgcgccgcttcccgagcagccgcttcccgagcagccgcctcccgagcagccgcctcccgagcagccgtttcctgggcagcggcctcgcgcgctgcctgtcgggcggcctcctgcgccgccgcctcctgggcagccgactgccgcgctgcctcttgcgccgcagcttcctgcgcagctcccgcccgggccgcctgccgcgccgcttcccgtgccgcagggtccttctccggcgccggggcattgtcgtacgccgactcaagcgtcgtttgttgcgccacgtgcgaggacgtcctctggcggggcggcgcatccgacgaggtcgacagggtcggaagcgccttcgtggactcgtcgatcgccggaacgtgggcccacggtgagcccttcatcacccggtccgatgccggcgacgccgaccggtccggacccgatacgccgggcgcgaccgattccgatcggctttcacgggagggctccgggcgtacgggcacagcgttgtgagccggaaccggaccgctcaccgtgatcggattcggacgcgccgcctgcggcgccggcgggtcggcgagcggcatgacgatcgggtcctgccgctgcacgaccacggcgtcctgcgaaccccggtgatagagcgccggagcgtcctgcgcgctcgttgccccggcgacaccgaacacgccgggttccagttcccggaacggcgtctccacaggcccagcgggctccgcaccgctttgcggaaccggctcccacggcgaccccgagcggccctgggtccgtcccgtcccgcgcgtttccggcaccgcatcgtcctgccgcggctgagcgccctgcacagacggcgtacccggggcagcctcgattccgggcgtcaacggcgccaccggcggaggcgccagcgtgtctccccggtcccgttgcggcggcggcacgctgaaagcgctcggcgggggcggcagcacgctggcgacatcgggtgacgacgcgggaccgtcggcgccgggcgggggcggaaaaccgagtgcgctcggcggcggaagcaggccgaacggacgcggtggcgcgggcgccacggaaatcgcaggcgattgctgaccggcagcctgcggctctcgctgcgccgggatcgacggcggcacagctgccgcgcccggcgcgccggccccgccgggcgcgctgctgtcgacgctgtggccggaggcgggccggctccggacggtgtcgtccgggcccgcctgactcggggcagcctggtgactcgatgccggtcggttcggggcggctcggccgacggcgtcctggtgactcgaagccgggggccggcctgccggggcggtcgaccaggggttgccctggtgggggatgaccggccacgtcgcggtcggctgcgcagccgcggacgggtcgtcccgcaccgccggcccaggcggggcgacgggtgcgggcgggtcgtcccgcaccgccggcccgggcggggcgacgggtgcgggcggaagggtcaggccgctccgaggcatccggtgggcgggctcgagacgtaccggcgcagtcggaacctgatcgagataggcctgcgcacgggtcaccgcccagtggccggccccgagcatcatcggcccgaacccggccaccctcccgaacgcctcccgcgccgccgcccgattccccagctcgtcggcgaccaccccgaggtcgtaggagatctgcagcatgagcggatcgtcatccccgaggctgaactgccccgccgcatacgccccttcgagaacccgccgcgcctccgccgcatccccggcctgatgccgcaccgacgccagctcccgctgcgtcgccaacacatccggatcatcaccgctgagcgtcgcctgaccgatttcaatggcacgttccagcagcgtggccgcccccgcgagatcaccagcggcaaccagcgagtgcgcccgttccagggccggagtcagcggggaggggtgggacaccccgccatgctgcccgctgttcccccgcaaaaccaggccgcaccccattccatgcccgtatgccccgcattgtccactcccccaccccacctgcagcccgcccgcgggaccgtgtactgttctcacctgtcaggccgacagggcgaccgagacccaggtgacaaccggggtgcggggagccgctaggcttgacgggcaggtccgggtggcggaatggcagacgcgctagcttgaggtgctagtgcccgcaagggcatgggggttcaagtccccctccggacacgttaaaccccatacaggtttactcgcgttgtacgcggtacctggtggggttttcggctttctgcccctctccttctgaggccgccgcaagcatcatcctgcggctacggcggcgaggctccgccaacggcaacgccagttgtaccggctcccgccgcacggccaccaccggctcgcccgctcgatcgccgggccggggctgaacaacagctgatgggagcgcgaagtcgggctcgtccacggcagcagcctcgatcgccacggtccctagtccgcacaccacgaccaggtcgtacgcccgcagatacgtccccaaatcctcggcatcctgcagatccgcaagctccaggtgctgaccggccagcgtggcgaacaccctcgcctcggcccagaacacccacttcggcccagccacgtccgtaggatgcgcggtggtgtgcccgtgccgacaccgataccccggcttcttattcatccaatgcgcgaccagccggcgcccgcacaccgcgcacagcagccgcccggtcagcgcataccggcggctactcccgtccaccggctccagcaccgcgctcgtctgctgcacccgcaggaaatcggcatccgacaccagcgccggatgtgtccgctcctgcgaggtctcccactcctcacgcgggttccacacccgcaccggccccagactcgaccgtttgtccccgggccgggcctcccgatgatcagtgaactgccgattccacacctgccgaccggtgtaccgcgcattcgccaggatcgccgcgaccgtccgcacggtccacaacgtcgcctgccgatgccggttacgcgcccggtcataggccccgggcgagagcacaccacgctcgttcaaactccgggcgatcgccgccacgctccatccctgcaaccgcttcgcgaacatccaccgcacctgcgggcccgtcaccggctccacctcgaaccggaacacctgccggcccctgcgcgtgccgcttcttcggatgcgaacccaccgccaccagccgatacccgtacggcggtcgcccacccatcgaccggccctggtcacgaacctgcaccgccatcgccgcccgggtacgagtccggttacgcaacacctcccgctgcgactgataacccaaggcccgtaacaacgcccgatgctcaacatcggtcagatcaacgggcccctccacctccggcaaccacacctgcaccccgtaggcattcagctccgcaatgatcggcctcgcctggctcccagagaacgcccgctcgaactcggccaccaccaccgcatcgaaccgccggtccggacgcgccgcctccgccagcaacgcagccgcctgcggccgatcccgccacggcgcactgcgcgacacgccgacatcgaaatactcggccacgatccggccccgccccgcgatcaaccagccgaccgcctcccgctgccacgcccgcgacgacaccggatcctgccgatcatccgtcgacatccggcccagaaacacgaacgcgatccccgccgacgccgctgccggcaccggcgaccgtccacgctgtcgccgggccggtccggcggtccgcgcccacgcgtcaaacggaccagcagacgacgatgtgaaaggcgacggcatgtcgatcaccgcgattccgaaacgagccgtattgcacgtctaccaccacggcaaccggggaacaatcgccctcaccagcgacaacagcgcagttgattcggaatagaataggaggtttgtcccaccgtcatcgtttgcagggacgatcggttcaccaattcggcttcagcccgggtgggttccgcaatacaaacctggccggttggccgacgatctgctcggctggcgcccagtggcgggaagaattgtcccgtccaccgggaagccgaagtcaaggccgcggtcttgccaacggcacgaccgagcccaggaccgtaatagggcttatcgtcgccgacccggctgatcgggatgagcgtgccgtcgaagatcgtgtaggcgagcagccggatgcacagcttgcgctgccccgctgcgcaagcgtgggcgtcgaggggtaagaaggagcagtgagcatctcggaacctgatcaggacggccctcgagtgacgtcgtcgctgcgggaggagcccgattatcgggccgcggccaccgccttcgaacacttgccggtgattgtgtcgatgtgggagggagccgagctgcgcggtgtagccgggaatcgccttttccgcgcgagtatccgcgaccgcccgttcctcggcctgccgctgcgcgaggcgctgccggagctggccggccaagaggtgttcgagacgtacgagcgcgtcctcagcacgggtgttgcggaggccgtccgagaatggcggatgctccacgaggtcgacggccgcaccatcgaggagttctacaccacgcatttcactcctgtgccggacgacaccggcacggtgcgcggggtcctgcagacgggtgaggacgtgacggcgcaagtgctgcgccgccgggaggccgaggccaaggccgcggtctctcaagagcggtatctggctgcgcaggaggtggtgctcgcgttgcagagcaacctgctgccggccaccctgccggtgttacccgccattgacctggcagcgcagtatgccgtcgctgcggccgagctccaggccggcggcgactggttcgacgccgtcccgctgcccgacgggcgcgtcgccctcgtcgtcggcgatgtcgtcgggcacggagccccggcggcagcggccatggcccagctacgcccggtgctgcgcgaggcgctgcgctccggcgtagacccggtgggggccgtcgaccgcctcgacgcccacgcgagcgagactccggccactcgcgcggcgaccgtctgcctcgtcgttctggacccctcggacggtgccctgaccctggtgtcgcgggcgcaccccgcgccgctggtctgcgctccggacggcgacactcgatacctcgagggcgggggcggcggcccgctcggggtcggtgccggccggtcccgcgcgagcgtgcatcggctgaagccgggagagacggtgctgttgtactcggacggtgtggtggaacgcccgggtgaaccggccgccgagggcgcagcccggctcgctcgtatcgccggcggcgccgtgaccacgcgcagcgacgccgtgccggaacgcaccaccgaccggttgtgcgctttgatcgtcgagcgtgtcacccgcggcggctacgtcgacgatgtcacggtcctggcggcgcagcgcctcgtcgagcctgtcgcgccgctggtcctggacgtgccggccgagcagcaggccctggctgggctacgggatgccctcacggcgtggctcacggcactcggggcgcgccgcaaggacctgctggccgttcccctggcggcgtgggaggcagccagcaacgtcgtcgaccacgcctactcagggagccgcaccggacggctgcgccttgacgcctcggtcgacagcggcgggcggctgcggctgcaggtcgccgacgacggacgctggcgcgagcggacggcgtcgtcgggcgggcgcggtctcccgctgctccgcttgctcaccgacgaggtgacgatagagcgccgggacgacggcaccaccgtgaccatgctgtgcacgctcgggcaccccaccgtcatcggtctcacggcatccacccccacgctcgtcgagcaggagccgttcgacgtcgtgcccgtccggcgcgatccgacggtgctcagcgtccggggacccatcgacgcgagcacgaccgccctcctgcgcaccggcaccctccgccacggcgcggggcttgaggggccagtggtgctggacctcgagcaggtgacgttcctcgcctctgccggggtgcaactcctgcacgagctgacgcatgacggcagagtcgagctcgccgcccccgtgggcagcctcgctcgccatgtcctcgacctgaccgggctctcggcgctgtcgtccgaatagcctgcacccctggggagaatcaccgagcatcgcggccgcgagtacccgtgtgcggccagacggtcgagcggtcaaggctcaggatgtggtgcctggcccgggagcggggtccgcgcgcagcttggcgagggcgagctgggcctccacccgtgcgatcagttcccgcgcggtgaacggcttgacgatgtagtcgtgcgcgccggcagccagcccggcgacggtcgagcccggatcggccagcgcggtcagcaggatcaccggcgtcgcgcggtgccgaggatccgtacggatctgggtgagcagggccaggccgtccagctcgggcatcatgacgtcgctgagcacgaggtcgaagccgcgctcgacgagcgcgtccagcgcctgccggccgtcggcgaccgcggtcacctcgtagcggtcggagagcagccgccgcacgtaggcgcgcatgtccgggttgtcgtcgaccagcagcaccgcgggcttgcggccgggcaatccgggtgcgggcggcgcggcatcctggatgcccgccggcaggtcttgcccgttgagccacagctccgcctcctccgcgaacgcacgccggtgctcgtttcgggcctccgggtgatcgtcggcggtcggttctgtcggccgccgctgggtcagcggcaaccacacggtgaaccggctgcccctcccgaccatgcttcgcacccggactgtgccgcgatgcaggcgggcgagctgctgcaccagcgccaacccgagccccgagccctcatggctgcgggctcgtgccccgcggacccggtggaagcgggtgaacagtagcggcagctggtcggcggcgatgccgatgccggtgtcgacgacttcgagctcgacgtgattcggccgtagccgcagagcgacggtgatcgacccggtgaaggtgtgcttgagcgcgttggagatgaggttgaggacgatgcgttcccacatctccggatcgacgggcacggtccgcggaagcagcggacagtccactaccagctccaatcccgccttctcgaccgcggaccggaacaccccggcgaggtcggtggtgagagcggccaggtcgacgtcctccagccgcagccgccggcggccgtgttcgagctgcgcgaactccagcagcgtgttgacgagcctgagcatgcgcagcgcgttgcggtgcgcgagccggaccgcggtgtgcacctcgtcgggccgcaggcccgcggccggggtgtcgagcaactgctcgagcgggccgagggtcagggtcaacggcgtgcgaaattcgtgactgacgccggcgaagaactcggtcttgtcccggtccaacgccgtgagtgcggcgatccgctcgcgggcctcctgacgacgccgggcggcggtcagggacgcgcccacctgctcggcgacgaggtcgaaaaacgatcggtaggtcacagtgagcgggatccgggcgctgaccccgagaacgatcacggctgcggtggagccatccgggtgccggccggccggcagcacgagcgccttcgtgggctgctccgggtgcggcccgcagaccaggccgcggaacccgtcaggcaggtcggccaccacgtgcggctcggcccgtcgcaccacggcggagatcggccatgccgtcgcatcggacaccgacatccggcgcggggcggcaacaccgcccggctccaggccgaccgctgccgccaggtgcagcttgataccagcgcgttccaccaggtagagcagcgcgaacggcacgtcctcggggtcgtcggccagcacggcggcgacccggtcgcacaccactgactccgcgtccccctcgacgagagccccggtcgccagccggtgcagcacacgcagccgtcggccgccctgcacctggtgcgtggtgtcgacgacggtggccagcagaccggcgatctccggtccctcgtagagagggctgtagctgaaagtgaagaacgcttcctccagctcgccgtcgcgcatgtagggcgtgggctggtcatgctgcagcaggccgcgcccggtatcgcggatccgccggaacaggggatcgttcaggtgcgcggtctcggggaaagctgacgctgcggaacggcccaggactgtcgggtgcttgccgccgatgatgtcgcggtaggcgtcgttgtagagcagcacgaggtcgcggccccacaacacgcacatggccaggtcgctgcccagcgccatcgccagcgtcgagcgcagcaccggcgaccagcgctcgacggggcccagtgccgagtgggtccagtcggtcgccgccatcagtgcgcccatctcgccgcccgaggcgaacaccgcttcggcggccacgagctcgggaagcggcagggaccggcccagcccgatcactcggtccagcattccggggatctccgcgagaggcaggacgaggtcggcgagcccggcccggacgaccgagcccggcataccgctggccgtggcggtctcctcgtcctcggcgaccacggtgccacccgtgttgcgcaccgtccgggcccccgccgtgccgtcgctgccggctccggtgagcacgatcgccagcaggtggtggcccagtgcgtcggcagccgaggagaagagttcatcgacaagcccgagcgacgacctggcctcgtgcccgcggacggtgaaggtgccgtccggttcccaccgcaccagcgaccgcggcggacacaggtgcaccacgttcggctcgaccggcccgccgtccgtggcccacctcaccggcaggcgagacgtccggccgagcaccttctcgagacgggacgccgacgggctgatgtggtgcgcgacgacgatcggcacgtcgaccagatcctgcacacgcccgagcaccaactgcaaggcctcgatcccgccgagcgacgagccgacgacgacgccttgataccgtcctgccatgcgcttcagtctgaaccacgccccaccgttcggtgtaggcgcgggtgggcagacgcagccggcctacctgctcaatggctgctacggcgcgccgtaacgaccttccaggctgcggtaccgggcatcgacgccggcctgttcaccctcgacacgctcgggtggtccgccgtcctggacatccaggtcgaccccctcgactagatcatcgtctcgcgggtatcccggcactacgactgacaaacccgagcggaaccggccacagcgccgcggcacctggaccaaggacgggtaaacacggcgagaagtcgacgcccaagacaccggaccgagccacgcagctcggggtgccaccacggccgtacgaaacgctgcggcgcagaccgctaccgggacagaaggtcacgtcagcgcccggcctttccggtccccgcgtcagggaagccgtcgccgtcgccgcatggtgacgccgatcggacggtcatcgccggctcaaatcctcggccgtgttgtcggccagcatcgagccgagcccggcgatgacagccagcctgcgcaggaaggcactcgcacccgtagcggtcaccctgacgtggcgtgcctgggccgcctcgtacaccgatcgcagcactcgcagggcggccgcgtccagcagcggcacctccccgagttccagcgtgacccgggcacaggccggctggtggcggatcaactccagcagcgccacccgcagccggtcggcgttgtcccggtcgacctcgccgacgacactgatctgcagctcaccgcgggccggcagccgggtgtgcagggcgaacagttcttccggcgcgtcgccggtcaccggccagcgcggcacctgatcggtcagcagacccgcacgcagccacgacagcgcgcgggccagcagccgcgacacatgcatctgggagattccgagccccgcggcgatctcggtctgcgtccggcgctcgtagaaagtggcgtgcacgatccggcgttcccggctgggcagatagtcgagcagttcggtgacagtgagccggtccgcggcgtcctcgagcctgccgtcgggattgcccagggtgtcgcccagcagcagatccccttcgccgatcggggtgctcagcgacaccggccggaacgcgctgccggcgctccggatccgcgagatctcatcggccggtacgcccacctgcccggccagttcggcatcggtgggacgccggtgcaattcccgggtcagctcgttctccaggcacgtcagctcgagcagcgcctcctgcatgcggcggggcacatgcaccgcccaggcgtggtcgcggaagtgacgcttgagctcaccgcggatcgtgttgacggcgtaggcggtgaacgagccacgctcggggtcgtaccggttcaccgccttgaccaggccgacccgagccacctgaaccagatccgcgtacggctcggaaccgccccggtagcggcgggccagccgttccgccatcggcagcaccgcgcggatcatgtcctcgcgcaaccgttccgcccgagcgctgtcggccgtggcacacgcgtcggcgtagcgcagggcgatctcgtcgtagtcctcccgctgaggggcaacaagaacctctcgttggtacggcatcggcgtcccccatacagctacgtatcgaccctcacgtagtgccgtgccctgagccgtggacccaaacggatcaccgcaagacatttacggcggacgttccagcaccatgtacccggcctcgccgcccacgctgcgggtccgggaccgctccagccggtcggcgtcgctgtacggcaacgcggccagctcgccgcggaaccgctgcgacggctccaccacactgtcgtaaaacccgggcacggtgatccggcccttgtcgtcgtgcagctgagccagcagccggctcatctccagcaccgggttcggcgccggcccggacaccgccccgctgtacacgtcctgcagcggccccaagatttccagcttcgccagcatcgtgccgcgcatactgacgcacaccgccggatgatctgcccgccacagcagggtgtcggagaagacgatcagatcggcgccgacccgatcccggttgtcctgcagaagctgccgcaggtgcgccgaccccgtctcctcctccccctccaccaataccttcacgttcaccgcgggatgggcgcggccggtggccgccaggtgagcacgcagaccccacacgtgcgcaagagcctggcccttggcatccgacgcgccacgcccgtagaggtacccgtcacggatcttcgggtcgaacggtgcggtctcgtcccactcctcgtccttggcggcacgaacgtcatggtggctgtagatcaggaccgtcggggcgtcgggttcggcgcaccatgcggcgtagaccgctgggccgtcctcggtgtcccacacctggaccgacggaaagcccgtctcgcgcaacgccgccgccagccagttcgccgaccgccgcaaattcaccacatgctccggaactccgggcgaccgacggaatccggacccactccgccagctcggcaaccacggcatcccgatgctccgccaggaagtcccgcacagtcgtggctactgatgatccccctatccgccccgccggggccactgcgtccaaaaggctcacgatcgcctgccgtcgcgcccggctacccccgaacggagtccctatgcacaacggggcgctcatcgagatcccccgtgaacttgtgcagcgttcgcacacggcgcacgagcctgccggagatcggtgaccggccgctgctgtcttcacctttcatgtacccgcctggtgccacgacgtcgacacctgcccgtttgaggcgtcgtatgttgggtatcgatgccggggttcttgcaagcccggaaaaccggcgtacctccgattggtgggtgtgcaggatggaggggcggccgtggtgacagcggtaccggtcgcgcgcgccgcgttggactcacgtgctctcggcgaagttcaggagctgatgagtcagcggtatgtcgagcaccgcgcccgggtgggggggcaccgccggggcttcgccgatcacagccggttcaccgccgcttaccgaacctcctacggtcggctgccccgacagaccctgcacacctagcccggacgcaccggcaggcgcgtacagaattagtggcgcccttcaaattctccatcaccacgtccgcctgaggacaaccgacgcagcgccacccgcgccgcaagtaagggccctgcagatcagccgcctcccggctctgtgagacaagcggcgtactacgtgcaccgtcaacgaagccctcaatttgggccccgttcaagcgcacttctttccgatgtggtcactggatggtgttttccgggtaaccgggatctaccgtctcgtgggtcagtgacaccagggacaggatcatgtcagcagggctgccggtcggggcgtagagccgcagtcgggtcttgctggcctggtgcagggcggtgagccggtgcagggcggcgacgccggcgctggccaggtgggtgacaccggtgaggtcgacggtcagcgttcgcacgccggcggatccggcggtgcgtacggcgcggtcgaactcgtccgccgtgactgtgtcgatcggcccgtcgacgcggattcgtggctgcggggcgtgcggctggtcgaggatcagcagtagctcgttctgcgcggcggggcggacggccggggcgggggcgaggtcggcggtgctcagcagccgagcgcggtggtgcacgcggtacgtgatggtggcggtggtgccctgctcgtcgtgtgtcaggcgcaggtcgtcgacgagttgcgagctcaggtgcaggcccaggccacggtcggccgacggtgcgggctcgcgccatcggccccgatcggtgacctgggcgtggatgtggccggtgtcggtgaggtcggcggtgacggtgaaccaatgttcgtccggcgagtcgatccaggcgtggtcgatcacgttggcggccagttcgataaccgcgtgccggatcgcgtcggcatcatgtgcgccgacgcgggcggtgtccagccaagcctgcaaccgcacccgtagctcggtcagcgtctcggagcgggccgggactcgcagatcgagccgggccggcgcggtgactcgctgagcggcaagcatcgtgatgtcgtcgctgtgcccgctgccgcgggtcagtagttccacggtctggatggtcagacggtccaccgctgtggggaactggccgtggaagatgcggtcggccgctgactccgtcgccacccgggccagttcgacggtgctctgtggcacgtcgcggccgggccgttccaggatcccgtcggtgtagagcagcagtatctcgctggtgccgagcttctcctggctcaccgggaaccgtgatccgacgccgagcgggccggcgccggtggccggcaggtaccgcggctcctgctcgccgatcaccagcggcggcggatggcccgccgtgcagtacaccatcgtgccgcagctcgggtcgagcaccaccacgcacacggtggtggctcggccgccggggagagtgacggcgatccggtcgaccgcgtcgatcgcggccggcaggtcaccggtggccgccagccgctcacgcagcaccacgcgcagctgacccatcgtcgctgacgcggccaccccgtgccctaccacgtcgccgacgatcagcgcgagccgtccgcccggcagggggaacgcgtcgaaccagtcgcctccggccgcggtgtcggcgtctgccagcaggtagctggcggcgatctgtacccggggcagcactggcagcgcggtgggcagcagtgccgactggagttccgcgacgacaccacgagcggcttcgtagcgcctctgggcctcggcggcccgccgctgcatggcccgtttctccagtacttgttcggtaatgtccaccagcatgatgttcacgccggcgttgacgccgtcggccccggcgaccgggctgatcgtgaagtcgatgaagatgtcttccagacccgcgccccgatcgagctggatgtgccactcccggccggattgcacctcgccggtctccagcgcgcgatccaggtagacgaacacttcctgagcgagaacctcggggaagacctcacgtgcgggcaagccgaggatgggacgctcggcggagaagaaacggtacgccgcgttcgcggccacgaaacgatgctcggttccccgcgtcgtccccaaagcgaccggcaactgctcgtatgactcacgaacagcctcaaggtcgccggtgccgtccaagtgttgggagccgtcgctcatcggcccataatgctatggcttggcggagcatgcctgccgccttcgaaccacggcgcggcgagatcggtgtccggcccatcgcgaccagcccgccgggcattaccgcggctcatcccgggcgcagcgtccggctgggggtggtgccgaacgtctcgcggtacagagcggtgaaacggctgtggtcggcgaacccccagcgggcggcgatcgcggtgaccgtggtcgtggcgggatccgcggccatcaggtcttgatgggcgtgttcgaggcggacacggcgcaggtaggccgtcggggtggtgtccagatggcggcggaaggccagctggatggcgcggaccgtgacgtgcgcggccgcggcgatgtcggcggtgctgatgtcgtcggcgggatgcgcttccaggtaggcgatcgcgcggcgcagggtcgacggcgaggcgtcgtggcggtcctcgatcgtcggatcggtcagtgcggtgttcgcgaaggtggtcagggtggccgcggccagcagcccggcgatgcccgacagcatcagcggagtcgtcgggtgcgggccggcgagcagctcagcggcgtaggtgcgagtggcccaccaactcgcggctgcccgcttcgagaccggttcgaggctggtgaagcggagcggttcggcgcgccgtcccggcgcggtggccgcgaccttggcgagtgagtcggcgtcgatgatgcagttgtccagcgtgccggggtgccacctcacggtgtatggccgattggggtgactcatcaggaacagcgcacccggctcgtagcgctgggtggtgccgtcacagccgcgttcgagacgggccgacgagttacgggtgacgacgatcttgcggagagcatcgatctggaacttgaggtcggcggactgatgggcggtctccaccgcgaacgtcccggcgtcgacccgctcatggcgcagcaccggcggcgttcccgtgtcccgcaatcgcataccggtgccgtaggcagcgttcagaaactcctcgaccgtgtcggtgccgcgaagttcgatactgctcgtctgtgccgcgggctgttccatctcggatcttccacgctcgccgggcagggcctcgccggccaatttacccgcccgtggcaccgtcccaaaccgcccggacaggtgagccgcagcccaggccccggtcaccgtccgtgaccgcgttccgcgtggccttgccgagcctcgaggtcaacggccttcgccggtacggggacgcagcgccacgacgggtcggccgaggttgtccgcagcggcggattcggccgggatggacgcggtgggatcgggcgggcacagcagccgtcgggtgtcgctgaggtccaggagccgggcgacgatgccgctgtcgttgacgacgcggaggctgccgccgccggtcaaggcgagctcgcggcaggtgagcagggcacggatggtcgccgcgtcgagatcgatgatatgccgcacgacgatgaccagggtgtgccgaccggtactcagggcctgctcgacggcggccgtgagctggtgacagctgccgcggtcgaacgaccctcgcgcctccacccgcgcgacgtgcggatctgccggatcggctacgagcaggcgaacggacggcatgtcgttttcgaccattcttacctcctggtaccgggaatgccgacgggccggcctggaacgctacgcttccagctttccgccatcatcactgccaggactacctcatcaaacgatccttcccggccgtgacccgtgcacagaacgaaacgtcgccgcgaatgcggcggcagcaggattgccggacgaatcgcggggaatgccaccgaaggacagcgtgctgaggcaacgatggtgcgtcgcgatgtggtggtgatcggcgggtcggcgggctcgcacaagccgttgagacagacgctggcgcggctaccggccgatctgccggccgtcgtgctggtggccgtgcacaccgcgcccggcgcacgaggcgggctcgccgactcgctggcctcgtcgtgcactttgccggtgcgggccgccgtcgacggcacccggctggagccgggctgtgtccacctggcagtcccggaccggcatctgatcatcgacgacggccacgtcctgcggctcagcgacggaccgcggcagaaccgggtacgcccggccgtcgacgcgttgttccgctcggcggcccgatggtgcggtccccgggtcgtcggcgtggtcctttcgggcagcctcgacgacggcgccgccggtctggccgcgatcaccgccgcgggcggaaccgcgctgatccaggatcccgccgaggcccgttttcccagcatgccgcaggccgctctgcggatcgtgccgggcgctgtgaccgtgccggccctcgacctcggcgacaccatcgcggagacgaccggcaaaccgagcaccaccgacggccggccgccggaacccctcatctgggagaccgacatgatcgcgtacggaggatcgaacactcccgaccgtgggcaacccgtcgccctcggctgcccggaatgtacaggcggcatgtacgtgatccgtaccggactggctgcccactacgtctgtcacgtcggcactcgtactctccgcagtcactgctcgcgacgcgcgacaacagcaccgaggaggcgatctggaccgccgtcagcgccttgcaggaaaaagccatgatcatcgaagaactggtcgcacagtccacgacctcaggtgacgtcaccgccgctgaggccttccgggcagaggccgaacgagccaaccgcgcagcctcgacgctgcgggaacacgtcaaccggtcgggtaacgaccacgccagatgatctcccggccggcctgcgctcagccgccgttgagcaggctgtccggcggggccatgctggggccggcgacagccgtgcgcaccgtcggcgacagttgacaccaagaagggcgaccgatggcgacctcgcagcatcccgagcatgtcacgcctcatcaccggcctctggccgacgccatcgtcggcttggccgagacgccggaccatgtctccggggtcgaaatccacctgaaggtgatcgccgctctggccgcggaccgggtggccgccgcggactatgcctccgtcacgactctgcagggcgatgagtacaccaccgtcgcggccagcagtgacatcgcttcggccgtcgacgaggcccagatcgccgacggagccggcccctgcctgcaggcgctggagaccggcgaaccggtcggcgtgacggacaccagggcgacgatggattggccaggcttccacgcggtggcacccgccctcgggctgcaagcgtcggtctcggttccgctgtacatcggccgcagcacgccgatagccgtgctcaacctctacggccgcgacagcagcacgatggaaccgctgatcgtcggagtcgctcacctctacgccaccagccgtgaactggctttgggaatcgatcccccgccggtgcgggatcccggagctgcgaagttactcgacgggtacgcgcgggcgctcgcggtgcgcacctgcatccagcgcgccgtgcgtctgctcaccgagctcgggggccacagctccgatgacgcctacacgaccctgtgcgagcgtgccgcggagcacggcaactcgctgagcgtcgaggcgaaggatctcatccaccgcaagtgacttctcgcccggctcgggcccgggagttgcggccggaccgaggccagcacatgacgtggccagaccaggtcgagcacgaacgccggtccgtgatcaggtgcgccggcgcaggaccttgatgctgcggccggacaactccatggtgtcggaagccatgaggtcgccagcatcgtcaacaagatcaaaggcgccatcgattgacacgtacggcgtgggccggacccggatggcgtccggcccggctcactttcggccgatcaggtcgagcgggacagggtcgcccagacgaccttgcctccgtgggccggcagcgtcccccacctgtgggccaggctttgcacgagcagcagccctcgcacgtcgagggggtccgccgaggctggtgccggcagtaccggcagggcgtcgctgccgtcgcgcaccgccacgaccaggtagcggcggcccatggaaagccgcaggtcgatcatcgtctgggcgtgcacgactgcattgctgaccagctcgccgaccacgacactggccgggccgaccaggtgcggcagctcccatcgcaggcagccttcggtgaccaatgcgcgggcgtgccgggcagcgccggaggtgggtagcagggtgtccttgatggtggaggtctgctgccggatcggcgcgttcagcgcctgctgcacgctggggtgcacggtgaggcgccgatatccctgggaaagcagctgtgccagctgcggatccggtgctgccagcaggaccgggacgccgggccagtgcgaggcctggcgggcggcggccaggaacaccgaggccgcggcggcctcggtgacgaccatctcggccaggtccaccacgagcgcgtccggctgctcgaccaggcatttgagcagcgcggtgcggaccgccggggccgacgccacggacagcttcccgcggacgcggacgagcaggcgcgttcctaccggctcgatctcgcactgaacatcagacacttccccattgtcgctcgcaatcgtgtgacctgcccagttcttcccggctcgcgccggacggcggtgcttgcgccggtatggcgtcgcctcggcacggcgcggacatacggtgacggcggtagggtcgatgcgaagggtcttcaacagcgaggacgacgtgagcaccgccgggcaggagccttccgtgacgttcgcttattcttccgcgccgcgtctgcacatcgacggcatcacacctgccgccgacggctccgtccatttgtgcctcatcggtgagctggaccaggaagagaccgaccggctgcacgccggcatcacggacctcgcccaccgctacgcctccgcgccgatccacatcgatgcgacccggctgacgttcctcgactccgccggcatccgcgccctgctcatctgccgcaaaagactcgaacaggccggctcgcggatgtcgatgccgcgggtgcacccgcacgtcttccaggtcctgcagatcaccggcctgctcgacgtcttcggcgtcaccgagcagaccgccggccctgccggcgagccgaccggccacgccgacgagttcatacctgccgcttccggcgacgagcgcgaagcaggctgaatcaacccaccccggcagcgccacatcgatctcgttgaggaccagcagctccggcggtgttccggcaccgatcccgtgcagcacgccgtgcactgtggtgatctgcccgaaggcgtccggcgccgaccggatgagcgacgacaccaccgcctgccgcggcctctcatccgcatggtttgccagtgatccaccggggtagccagcgccggcatcccggcgcccgcgacaagggacgatgacccatggcaaccatgatcaccgccggccggccggtcacccggaccatgccggcgccggcgctcaccatcggcgtggaggaggaattcctgctgctcgacccggtcaccggagccaacctgccgattgccgatcaggtggccgccgcactgccggagtcggtgcggccgcgcagccgccgcgagatgcggcgcagcatgctggaactggtcaccggagtgtgcaccggcctgaacgaggtccgggcgcagctgtccgagcagcgccgggccgccgccgacgcggccgaggcggccggggcccggctggtggccgtcggcgccacaccggtcgccgagctggattcgagtatgcccgccgggcagcgctatcacgatcttgccgaccggtacggcccggtcgccgcggacccggccgcgtgcgggctgcacgtgcacgtcggcgtcgccgaccgtgaactcgccgtgcaggtgtgcaaccacctgcaggtgtggctgccggtggtccgtgcgttgacctcgaactccccgttgttcctcggggtcgacaccgggcacgcgagctggcggtcggtgcaactgctgcgctggcccagcatcggaccgacgccttatttcgcctcagcgcgcgactacggccgtaccgtcgaagatctgatctcttcttccatggtgctcgacgaagcatcgatctactggtacgccagactctcccccacctacccgaccgtcgagatccgggtcggcgacgtctgcaccgacctcgacgacaccgtcctggtgaccgcgctcgtgcgggccgccgtcgccacggccatcgccgacatcccgggccgggatccccgcagcgcggccccgcgactgcgtgctggccgccgcgaactggcgctcggcccgctacgggctcagcggcgacctggtcgacctgcggctcgggcgcgcccggcccgcgtgggagctcgtcgacgagttcttcgccacggtcagccccgccctgttgaagtccggtgatctggagctggtggtcgacgggctgagacggctgcgggaccgcggggacggcgccacccggcagcgagccatccaccgcgcgaccggcgatgtgcgggcggtgctgaccgctctggccgcctggacccgggccggttgaacgcgtcatgaggggcctgcccggctgttgtggagcgcgcgggacgaagccgctgcccgctaggcacctagcgtgatgcaatcagcgttttgcgaaagcatcgtccggtggcgggtcagctgatcggcgcggagctgatcggcgcgccgtggcggtgcgttcgatcatctggtcggcaatgacggcgcgctggtgagcacgatcgtaggctcgttcggcgtcagcgcgcatggcttcggctcgggaccacgcggcatcggcaccgcctttgtccccccctgccgcgcttcatggaacccgtggccctgacgcccggtggcgccaccgggagcccttcgtccgccggttcaagaatcgcgtcatgcacctcaagggtgccagcgccacacacggcgccgtcaccgtatcaatgtccaggcgatgccaccgccggccccactgagcgtggactttgttcgggtgcgggcccgcatccaccagccgacacccgtacggcggccgaccacccagatgccggccctgcgcccggacctgcgccgccatcgccgccgcagtgcggaaccgattgcgcagcacctcacgctgcgactggtgacccagcatgctcagcaccgcccgatgctcgggttcacccaggtcaaccggcccctccacttccggcagccacgactgcacgccgtacgcgttgagctgcgcgatggtcgactgcgcctgccccgccgcgaacccgcgctcgaactccgccagcaccaccgggtggtggtcacggcaagtgagctgaccgagcaggatcagctcacggccgtcgcgaacttgaactgcagcagccgctccaccggctcgaaccccggccggtcgcccacaccggcccaccccgccgtcacacttcccgccatcgccgcagcaagtgccggagtcagcgacgcccaccacgggtgcagcggagagcgccgcttcagagatcgctcagcttgaccacagggaggttagcgacagtcaccagcccgtacccccaccgtgccgaacgaggtgatccgccgtggcctttgctatcgccgccttccatagcgccgaaggccggcaggcggtccaggcgctgctggcgcgttcgggtcacacggtggcgcatttccgtaccggcgcggccgccgtcgccggggccctcgccaaacgaccggacataatgatcgccgacacccggctggcggacatgagcccggtacaactcggtgacgccttacgggcccggccggagactgccggcatcccgctcatactgtgcggatcggtagacgccgagtccaagcggatggcgcaagacctgcaccaacgggtgttccgggcgctgctgaccccccgaagcctccaatcggtgatcagcgccgcgctcgcggtgcgaggcggcagcccggatgccgcggtagccccgagatcggccggcgacacccccaccgccgccgcgcccgccacgggtgagcagtggagagtgctcctggtggaggacgatgactccatcgccgatccgctggtcgaaggcctcgcccgatatgggatcacggctgaccgggtagccaccggagtcgcagcgctcgccgccccgccggcgaccatggtgttgctggacttagggttgccggacatcgacggcatcgacgtcttccagcaactacgccacaccaccgacgtacccgtgatcatgctgacggcgcgcggtgacgaagccgaccgggtgcgcggcttggagctgggtgcggacgactatctgggcaagccgttcagcatccgcgagttggtggctcggatgcgggcggtgaaccgccgcagcacgacagccgcggcgaaccaaggccggatcactgcgccgacaggactccgatgacccgccgactgctggcaacctatgtaacgtttgccctgctcatcctcctgggcctcgaagtgcccctgggctacgcacaaagccgcaacgagcaaaaccaggctttcgagcagctcgaacacgacgccgaggtactcgccgccttcatcgactccgcgctggcgcgcaacgacatgctccagatcgaggtgctcgcgcgcgagtcggcgcaacgccttggcggaaacgtggaagtcatggacgcccacggccagattctggccagcacataccctccggagcgaccggctgacagccccacagcacgctccgacgtcgatgcggtgctacgcggacaaggcagagtcagcgcacggatgtcgacggcagcggacgtgcggacgatgtcagtggtcgtgtccgtacacccgggtctgcagccacacggcgcgctggaagtcaacgtgccggccaccgcggtgacgacacgcgtgcagcactttgaactcatgctggccgcagccggcatactcctgctggcggcggccgccggcacggcgtttgcgctcgcgcgatggatcagcagaccgatccgggcgctggaactggccacccggacgttggcagacggcccgctcccggtgacgctgcccgtcgactcgggcccgccggaagtgcgacgcctggcagtcacctacaagacgaccgcggagaggttgaacacgctgatcacctcgcaacgctcgttcaacggccatgcctcccatcagctgaaaacaccgctggcagccctgcgcctacgactggagaacctcgaacccgacatcgcggccgacggccacaacaacctgcaagcggccttgcacgagactgaccgtttggcacggatggtcgagctgctgctggcgatggcgcgagctgagcagagcgcattgccccaggaagacggtttcctgaccgataccatcgacaggcgaatctgcttctgggagcccttggccatcagccgcggtatccacctggccacatccggcccggtggatgtcggcgttcgagcggtccccaccgccatcgaacagatcatcgacaatttggtttccaacgccctccgcgttgccccccacggaagcacggtcaccatcagctggcacgtgatagaccaggccgactcagccccggaggtcgaactccacgtcatcgacgaaggacccggactcaccgcagaacaacgaacacaagctctcgtgcccttctggcgagcacccagcgccggcacggggggaaccggactcggcctcgccctggtacgtgccctcgccgtagccagtggcggtactgcggaactgcgaccaagcggaaccggtggtatcgacgcagtggtcagactccccgccggctctggccgtagccatcaacagctctccgcgatgccctcgaactgacctgccctcttatcggcgtgatgcgacgcactatcgcccgaaccgatcgaggtactgctgccgaatcgcatcgagccgctccttggtatcttcggccgaccagaaggcccagccgttgccagccacgcccaccgcgtcctccatcgccttactgggcgcgcttgcgacgccggctgcagtctcgatccgtccgtccgggcggacccgggcgtagtacatctggccacgtcggcggccgaagagtctgtcgcccgcgctcagtaagccggtctggaccaagtcctggaaccggactccgtagcgggtgcgcctcccagtcgccaccggtccgggcgccggtggcggcgccagtccgagcgcatccaggctccagatcttcttggcgatttcgcggtagaaacgaccgcgagcgtcgatgaacggctccaacgcggtgctcgggtcataggtggcgatcatggcgaacaggccttcgctggtgaggaacttccggagccggacgttgcctcgttggaagaagtccgggttgagcatcccggccaatcgcgtgtccttccggtacatcgcgagcttgtcctccaagagcatccccccatagcttccgttgtccaggccgtccagtagcagaagcgccccgatccgattccgcaggaagccgtagtagcgagcgtccggcaccttgtgtgcatacttcgacgccgtgctggtgaagagatgctcgatctcgaagtcgcggtcatggtgccggcgcagcaggaagcggtcggtgggatccgtttccccattggtcgcgcccatctcgacccacgcggtcagacgggtcagcacgtaatgcacgaatcttcgcttggtgtcgtagcgcagttccgagatgaggtccagccggactggccagtctgcggcctggtccccgagtacacggccgagctcctgaaccgactcggacagccgcactgcgggcatcaccgaggagacaagctcatcgacgtgcctttgctcgaccgattcgtcaccaagcgtctgcgtcacatagaaaaggtccagaaaattggctaccagaccggccttctgctttcgctcgatctccgaatcgccagacctcagcgcggcaagggtgagatcgaactgttcggcaatgccgttgaaagcgttgtaccgcaccgcccgcagacccgggttgatctcggatcgcgcgcgtagcatggtgacgtacgtggtgtggaacgggtagagcacctcggtcaccaggcgggcccgatcgccgctcttgcggttgggccagatctcgcgctcgtgcacccgcacccactcgtgagtcgcatcgttcaggctcggccccggccttcccacggcctcagggaacctcgcccggaagacggcgcgcaaataggcgaaagcggcccctttctcgacgtcctccagagccgacaccatcgtggtccacgcgccttcgatctcgcttggatcctcttcggcatcactgagcagaaagcgcttgagatgatccatcggcgagagacgaaccccgcagtcgttgatcgactggaacatctcctcggcacgttcccggtcccccgcatccatcacgaccagggagacccggtagagcaaccagtcaatgaacatgatcaggacatcgccgcgcagctgtgcggggtaatgaagatcgatgtactggtacgcctgccagatacgccggactgatggccgggcaccggcaacatcgaacccacgaccgttcagcagagcgttgaagcaggcgtcgtactcgtcgacatccacgcggaacgtgcgcctgccgaaccgctcggacatgatcaaggtcaaaagctggccggccttgctcctcgccttcggcgccgccaccgcctgccgatggagatagatcaacaacagcagtagcgtgatgatgcgctgctggccgtcaaccagcgaggtgcgtccgtccgcggtgcagatgatgtacggaccgaggaagtacggatcgtaggacttcacgtcacccagcgaatgctcatcactcaattggtcgagaaactttcgggagagatcgttcatcagccgcgcgacctgcggctcctcccagacatactcgcgctggtagtagtcgagaccgaacgactccgtaccaaacaacgcgtcaacggactgctcgcgggcactgaccagcttcttgccaccgcgactcctggccatgacagccccggctacagggccacgaccgctttggcggccaccaccggttcaccgccgccacgccagaggtacccggagcgcacgacccggacaacggtccccggattgggcatcgtcacttcggcctcgtgagagtccgggtcgaacgggaccgtctcaccgggccggcccagcggccagagccgcttgcggcgcgtctcatccatcaagagcttcgccacctcagcaatggtgtcgccgcgagactgcaggacctcaacagccacggcgagatcggcgaccagcctggcctcctcgaactcgtgactcgtcggcccggagacggtcgactcgccggcatcgagagcagccgccacattctgcacgagaggttgaaccaaccacggcggcagcttcgcgagtaggtttcccgccagcacgtcgagggagtcccgggcgggcttccgctcgacagaccagccgtacttgccgttggcggcggtgatctgtggatgcagcttgagggcgcgctgaaaagccgtccaacggcgatcgacatctgccttcttgacaccggcctcgaccagcagcgccttgatggcttgcgcgcggatcggctcaggcgaggttcggatcacctcgaggaatacggctccatgatcgtccgcgaactgcttgacgaggattgtcgtatccaacgcttattacccccaaacccgacgtacacgtactcgcatgctaaacaggcggattgaagacagtcactgtcagcgttgtgacatccgcttggcgtagccatgtgtagaaggaactgctacgccagctgacgcatggacaccgaacaactcatcggcgcgctgatcccgcccatcctccagccagcccgcctcttgccaccatcaacgtggggtgtcccatagacggcgtcgatgcaccccgggtcggttcatctacatctgagtcttaagcgaaggaggtcgtcgggatcgcgaggaagcgcctcggcactccggcctggcggcggaccgaagtccgccgccaggtctcactcttggtcagtcatagtcgccgaccagggcatcaccaggaagactgagtaccggcaggttgcccggcaatgcgagcgggtgcggctcacccgtcagcccggacagcgccgtcgcgatctcctgcagagttgccttcacgtagcgagcggtcgcgccggcgtcgttcggcgtttcggctgaccggcatagacgagcgcgacggcctcccggcgctgcccttgccggtccggcagggtcagccggggaaccagcggcggcagcggaaccgacctcgccacggccaccaccagccaaaacgcccggctgccgcacaacacacggatgctgtggacgcgtggtctagtgtgactctgttaccaaaacgggcatagtgtgtcagatacaccgtataggggtgagagtccccctccgaacacagctccactaggtatacaggtgcacctcaggcccggtctcccgaccgggtctgatgcgtttcagggaactggtaggggaatcgtattacgtcagccggtgagtgacggtttgatacgtcgggatgcgggtgctgaccaggtctcgcgttgtgcacgccgcttttccatgacgagcagttcggccttgcgttcgtttactggtctgtaccggccgcgcttgcttcagggccggcgaccaaacgggggcggagccgaagccccgcccgccgctgcggcgattaccgccggtcgaattcgttggctttgacgcccgctacgaaggcatcccactcggccgccgtgaagatcagcgccgggccggaccggttcttcgagtcccggacgccgaccttgttgttctccaggaacgcggtctcgacgcagtggccggcggcgccgctgtagctgctcttgaaccagatagtgctgctgttcatgatgtttcccttcgctcgccccctcagctccccgagggggagtctcatgcgggcggctctgcaggccgctccatcagcgtgtagatcgaatcccgcatgtgccgcacgtaaaacgtccgcagcaggggtatcgccgtggacggctcgacctggacgcctcggacgtaccggccggcttgaccatgccggcgtcaccgggctgcggcacggctgaaccagccctgtcggcgcggaaacatgagcaccacgggttgcccgacagattcggcacagcggctaggtggcgtccgcaagctggatcgacgagtcgacatgctcgtgcggctcgtactcgatccgctcgatgatcgcccctcgaccgggcctcagcgttgccgagttgacgcagcggtgcggccggtcatgggaagtccgcaggcgatcaccggaaggacgacccccggggaaacgtcggggcatttcatcgcccgccgcaggtcagatgcatcgaagcgacgggaagacgccgtccgggtgagttcactcgggccgctgccctgttgcggatactcgcggccgccggtggtggcagtgccgcccttggccgcgaccaggacgatgttgctcctggcggtcccggcctataccccagatgtcgagttcgccgggtttcggatcgtcattttgcggccccgcccaatagggcatcgcgcgtgttgccggctccgcaagctcgggcgtactgcctccccgagatcttcgacccgatgtggacacgtggtcagggcttgtgtacggcccacttggtgcacgccgagccgtactttgcctggcggtcgatgtcggggttgaacacgcggtcggtgagccaatggcgctcgccgtctccggactcgacattctgcatttcgtacgactggatgacgccgcggtggcccggggcggcgtagggcttctcgctgccgtggtgccagtttccgaggtcggcgcagaaggtgacccgctggcgatcgggggccatctgttccacgcccacgctcttgacccagatcgggccggcccaggggtcctcgatcggcgacgtggaggttatgaacggggcgaataccgatgcgtagtagtcatcggtgtacaggtagcgtccgatcgggaggatgggagcccagtcggtggcctgcttctcccaatggaggaacgcgaaactgcgccgggcggcgaggacctcttcagtgtcgggtgtgctggtcacatcccaggtgatcggttggtttgcggtcccgttcatcggcactttccggtatgcctcgtcgaacgtcatggatggtgtgccggcactgccgttggctgcgggaggggtggtcttgtcgcctcgtgggtgttcaacggtgcaggcggcgagggtgagccctacggtcgtgaccagtgttgccgcagtcagcgctttccgagaggtcaaggtcttactccgtcccatcactaccaccaaggatggttctcgcccacgtccagccgttttgataggcatctgctccatggtcggcggcaatgcctacaacgctctggccgcgcccatttttgtactcctgccagtcctgaaaatcgttgtgggtccaggtttctctcggtttcggatgtccgtcgacgatgaggctgtccggcaggtcgtgaagtttaccgctgttgtagagggattgttcggtgaggtgggccgaggtgttccgggcggcgccgagcgcatcggcgactttgaagacagcgtggccgtgattgtcgaccatgtcgcgttgctgggcttgcgtgagcaggtcgttgacgtagttgttggccaggtcgccgacgaccggtaccgggatcttgccggtcactttgcccatcacctgctcgaccaaagtgtccacgaccttgtagtggtcctcgacgtgtttgtcggcgatcgcgtccagttcggcgctctgcgtgtgtgtgtggctgcggcggcgccgtggtcgagggctcccagcacgctgccgtagttgtgcgagacgtgctccatcgcgttcaggtggtcggtcatgtcggcgtgcgggttctgccggccggacaggatgtcgtcgtagctgcccagggcgtaggcggcctccgcgtcggcgatggtgttgtgcgcgcccgggtccttgccgaggtctgccaggaagcgcacgagatggttccggtcgacctcgatggtgacgccgggaatcgcctcgtgggattcggagatgttggcgttgatctcgtagatgtagcccgacgtgatggtggccagcggctggcgcagctgcgggttgatcaggtcggtcgacttgaagtcggtgctcgtgccgtgaccggggaccacgccgttggggtagtactgggcctgctcgtcgacgccggtctcgtagatgatcgactcgacgatgtgccgggcttgcggtccggggtggtccatggtggcgtgttgtagtgcgacgccgaagttgtccagtgcggtgttgtggtagtcgctgccgtgttgcagcacgtcggcggtccagcccgggccgcccgcaacgtccgcggtcgcactccagttccggtcggtgagcaggtagtcgagccgggggaggcggccgccgagcgggccgtcgctggtgaagctggtgacgccggtgagcaggtcacggccggcggcaccgttgtgggacagggcttccatgaggccgttcatcgggtcaagcccggccggaacatggttgtcgtcgtgtccctgggtccagtccaggcgcaggttgtccggacgatgcgcgtggttccacagggcgctgttctcgcccttcgacatctcgaagtcgaccatgtcgccgccgacggtggacaggaatcccgcgtcgtagtcaccatggtgcagcagcggacccagcagctgatagccgtagacaccttcgacgaaacggcccgggctactcggatcgccgatgttcatcgtgctgcgcccggctgtcatcaggtcgctgacccactgactgggcaggtcgtactgcccgggcagccgggtctcgccgtgcgggccggtcctcgtgccggtcggcgtggtcgccgtcgccagcatgactccgagaccgttctgcaggtcgcgcaccatgtcggcggtgtcgcggctgaacaacgcactgttgacgtccttgcccggataatcgagctggtaggtcgccaaggtgccgtcgagctgcagcagtccttgggggcccagagcggtcagcacgtcgtgggcgaaggccttgtccgtgccgtacagcatgatcaggttgcgcagctcgtcgagttcatcacgagtgggctcgtacgtcgggtccttcagcttgttcgccagctcctgggcccgagtgatcgcactggccgggctcgctccgaagccggtcttcggcgacggtacgttgctgttgatggcggctgctgtcgaaacgtcctgcgaccgggcgttctccaccacggttcgcagatcggcgagcagcgagccgatctcccggccggtccggtccagattgccacccatgtacgccgtcgcgggcgcggtgatcgtcaccgccgccgtgtccacggtgtacccggcctgctgcgccgagtagatgatgcccgcggcgatatcccgcatggctttcatcgcgtacgcgtgttggtcgaaagcatcggccaggcgtttcgccggcaggtaggaattctccacctcggcccgcagcatggccgccttccgcagcgccgccgcagatccctcgccctcgggccacacttcgccgagatcgcgggtgccggcgagtagctgctccgacgtggcatcaataccgcgggccaaccgctgccaggcatcggccgcggcatgccacggcgcggcgtcgaactcgagcagatcccgcaacgtcaggtggctcatcggcccgcccctgccccaccgccgtgcagatcatgggcgttgtcgcggtcggtgccctggtaggtctgcgccgcggcggtcaggctccggccgtactcatcgatctcgccggtgagccgccgcagatcagcggaccacgccttctccgccgcctgcgccgccgtagcagccgccgaaaccggccaaggcgcgggcgccagccgggcgccggatgccgtcaccgccccctgcagcgtggtgaaggcatcagccacattccgcccgataccacccaacgcctcggcatcaacctgcagcaccggcatcccccatccgaacatcacctgccgccgaacctcacatgtcctacgccaccgagacggtccggccggccggaccgaccgctctgccgctgcgccgcagctctaccggtccgctaggcacttgactatccgcagaacatcaaaatcccaggatgtatgactcttagaacccaccaacccgaggttggatgatagatccactgctggaagctgtggtaacccctcgacgtggagaacaccgccggcgagccgtgggttcaacgatcgtcaagtcggccgggatgaaccggacccggtcgccttgccactgccgcgctcgagatcgacagcccagccggcctcacggtgcgccgccgcgacgacgaaaacgagcagccccgcgtcatagcctgtcgcccatgtctgccgtcgttcttcgtaatccgccaagtcgctggggcctctgggcgggtatcggcggggcaatgctgattgccacgctcgcctactttccgaccagttgtgacccggccgaccattcctgcgccccgttgccggtgggctccagttcggtgattttctcgccgttctggggcgggttcctgctggccgggtacctgtcgtaccgggcccgcgtcacggtggacagcgagggtatccgcgtgaaggctgtcctggacaacaaactgcacccgtggtcgaccatccacgatgtcagggtggtcaaggtacggcgatacaccaactacttccgcacggggaccgaacgccggctggagatcaggaccgagggcaggagggggatcgtctcctgggaggagctgccggtgcccaaggccggcctgctggtcggcaagaagaagttcgatcggcaggccgagctgttctggcgggcctggaatgcgcagcgcagctcccggtactgaccgaaccaccgttacgcgtttcagcggctgatccagcggcggcgggcgcaggtcggggccagagtcatcgtggcgtggcatccgcgtgagagggcgccctgtttgttcggaccggtcaacggcgcggtgcgacgccttcgatgtcgcgggcgaacgcacgcagcgtcgcggcgaagccgagccggcccgccagggccaacaacggccccgcgaaccgggtgacccggtgcggggagacagtgacgtcctcggcccagaccacgcggctccgcgaatcgggcagcggcgtcaccgagaaccaggcccggccgcgtacgacccggccggtcttctccacctcgcagcggccgggccgatcaccgggcgagtcgccctgcggcggttcccagccgacgaccgtcatcgggtcgtcgaaggccacaggtccacggccggtgcgggcaacgaaggcggcgccgacaccgtccggacggtcagtgacggttcgtacggcggtgagcggggcccaccggccatgccggggccagtccaccagggctgtccaggtcgcggtggccggcacgcggacttcctgaacgacgacgaaacgtgccacgactgactccacggacgggaccgagggcggccggacacgtacgcccgccgacaaccatagatccgcactcgacgccggaccaacgggcatctgcagatgcctcggcaggatgccggctgcagggacgcgtggagatcgctgatcggctgcccggggtcaaccctcggtataggcgagttgtttgaccgccaccgggtcaccccccgagaacaccaccgacgcgatcgccttcccctccggcgcggtgtagctgacctgcggtgccgccccgaccgggcagtcgaccagggtgccgtcggtgagctgggcaacgaacgtgtgctcgccctcgcccgcgtaggtgagccggaccacccgggccgccgtgcggaaccggaaccgcaacggcaccgagttgcacacgaggatgctgcccgggtccgagccggtgaggaacgtgccgaggagcgggtcggtgcgcaacgccagagcggtcgcggcggtgcagtccggggtggcccggtcgatgaccgtgctgacgtcgaggccgtccggcgcgaaccggtcagcggagatcatcgtgtcgccgggcgtgcggtcgaagtcgaggatgaactgggccggcgaccgcgccggcgccggcgccggcgcggtcggggcggccttcggcggggacggcgcagcacgagggcggtgccgccgatcgtggcggccaggaccagcgcggccgagagcgggccggcgacccacatcagaccgaccgggatgcggggccgctgccgcatcagcacctgcttctcggcccgcagcgatccggcggcggccacgacgcccagggagcgggtggcgttgccggtccacgggcgcggcgcggtgaccgccagccgggcggtggcggtggcgcccggcccgaccgtgaccgtcgcggggctgagggtgcactcgacgccccggtcggcgatctgggcgccgaggcgggtggccagcggcgtgttcccggtgttcgtcagggcgagctcgtactccgcggcgggttcgccgtcggcggcctcggggcgcacggtcaggtcgagggacgcggcctcggcgacggtgacggtcagctcctcgcagcgggcgctcgcggcgtcgcgcaggaccacaccgaggacgtggcgaccggcgtacgggggtcccggctcacccacggtgatccgcagggcgacggtacgggtgtcacccgggttgagctcgacccgcggcgggtcggccaccgcttgcccggcggggatcccgcggaccaccaggtcgtagtggctcaccagggtgccggtgttggtgacgcgcacggtgacgtcgccgctgcggcccggtcgcaggtcgagccggtccggttgaagggagacggtgaccggggcgggcctcagccttggacgctcggctcgatccacagaaactgctcccgccccggcagttcgccggcgtagatccggatgcgaatcttggtagccccctcggccgggccgagatcgaaattgaagtcatgaatcgtcgcttcgggcgctctgaactgatagccgctgatctgtttccaatggtcgtccggcatgagggcttcgacggcgaagagcgccccgggcaccggatcaccgtcggtgacgttaccttcccattccgggcgaacacgaaatgcgatccgactccggaactggtctccggacaccaccggagaaggcaacgcgaaatccccctggatccaggggtccagtggatctttcacgtcgtacaaggtcgacggttggagctccaacaccgcaggggcgctaccgtcattcagcgggatcagcccctgcgcgtaggcatagacgagtaccggcggattcgtcggtggagccggctccgagcccggcgggccaagggcccggacggcttcggcttgggccggtccctcgcccgaatcccaggtcgcggagggcgccagctcgatcagggagatcggtagccgcttgaaggtcaccccgacggtacggctcgtcgtcgtgtccacgacgcactccggggcggtcccggcgcagtcgccgctccagccggccagcacgaatccggcggcggggacggcagtgaggccgagggtgccggacctgccgtccaagggctcgtcgcagtcgccgggacaggcgatgcccggtccggtgaccgtcccgccggccggggcgttcacggcgagcgtgggacggtccgtcacctggacggacgtgcgggcggagacgacgacaccatgggcgaaggtcgccgtcgcctcgacgtcgtaggtgcccggtaccggccacgtgtgggcaacccccgggccctcggcgccaatctcgtcgccgaaggtccagatgacgctctgcggcgccggcgtgccgggcgtgacgatcaggttcagctcgtcgggttcgcccaccatcacggtgggccgggcggcctggacggcgacctccggtgtcaccggcggcgggctggacgagggccgcctcgggttctcccccgcaacgtgcaccctcggggtcgaggtgacgcttctgctcggcgtgggggccggttcggtcggcaccggagcgttcggggacatggtcgcccgcgacgacgtcctcttgtcgtacttggcgacggtcaccaccgagccgtcctcgcggatgactccggctcgccacgtccgggggtcgttgaagaacaccatgccgtcgtggacgaacagccgcaggtcgcccggcggccgcagcaccgtgcgccggatgacatgtccgctgaccgggtcgacgatgtggacgcggccgtgcgccggttcggggacgaagagccgccccctgttctccaccggggtgccgagccgatcggcggcggcggtcagcgtgatcgcccggccgcacccgttcacggtcagctcgcagacgctgaccgtaccccggagggtcggatagacccgggcgtcgtccggcgaaccgccgatcgccgggtcccggtcgtcacccaggtcgatgcggacggtcgccgtggatctgccgtcccggtcgagggtggaggcctccgcggtggccaggtcgaccagaaccggcttgccgccggcgagcagcagccgtcccgcgccggccgtgacgacgcgccgccgtacgacgctctcgccgccccggacgacggtgaggttcccggccccggtgtccaacgcccagagcacgccgtgcgcgtccagcacggccgcgcccgggtcggtggccaccgcgagcgggcggggtgtcccccggagggcgagcgtctccgggtcgaggacggcgagcaggccgtgcacggtgtcgaccgcgtacagcacgccgtcgccggcgaagacccgcacccccgtggtggcgcccggaacgagggcgaccggtggcgaggcggtcatcgtggcgccgctgacccggctcaccatgccgttcacggcgtccaccacgtacgcgtcggacccgtgctgcacgacgtcgaagtcgtgcgtcgccgcggcgaccggcacccgcgcggcgacctcggcgttgctcccgtcgagcagttcgacctcccccggcccggccgacggcagccaggccgcgcccgccagcaggtggggcgccgcggcgtggtagccgtgaccggcgccgaggacggccgcggcggccaggccggcgacgccggtcagcgtcgagagaccggccaccacccgccgcgcgggtacgcttagccttcgacgcgcggattgacccatgcgcaccagtcctgtgaggagggaccgtcggtctcggcccggaggcggatcgtggtggcgcccggccacgaggagagcgagacgtcgacgtcgggcatcacgcggtcggaggctttgtcgcgcgtccggaagacctcgtgtgcggtgccgtcgggcatgacgaccgataccgcgaagtcggcctcaccgaccgagaccccggatctcgggtcgagctggatgaagccgatccggctccggaagtgatcgccgaagatgatcggcgacggcagggtgaagtcgccctggatccagccgtcctgcgtcgatcccggctccgtgtacgacgggtgggtctccagatactcgggtgcgggggcgacgccgtcctccaggatccagctcccgggcgggtgcaccagggcgaagcctctgccccccgccttctgggcggtcgaattcgggtcgaagatctcgccgcgggaggccggcgcgccccggccgccggtccaggtcgcggccgtcgccatctcggtcagcgacaccgccacccggtggaaggtcaccgacgccacctggttcttcgtggtgtccacgacgcacaccggatcggtcccgctgcagtcaccaccccagctgaacaggacgaaaccgggatcggggacggcggtgagggtccgggtcggtgcgccgtcgaaagggatcaggcagtcggcgaggcagtcgacgcccggcccggtgaccttcccgccgtagaccgccatcagggcgagaacgggacggacggtcaccacgatcttgacgtcggcggaggcgacggcgccgccggggaaggtcgccgtcgcctcgacggtgaactcccccggcttgtcccactggtgttcgacccgcgggccggtgtcgtcggtgccgtcgccgaaggtccaggtgatgtggtccggcttgagcgagccggcggtgacgaccaggtccagggtgacgaggtcctcgaccatcgccgtcggggcggaggcctcgatggtgaccgcgggcttcaccggcggtgccgggctggccgacggggcgggcttcgacgggggtccggactgacccatcgcgctgccggtcgggtcctcggcgggggccggggaggacggcggcgacgggtgatgcctcgtcggctgcggcgccggagccgacgtcgccgagggttgcggccgggggccggtcggcggcggcgtggtggtcggtgccgcgcccgggcccgcggcgttcttgtcgtacttggccacggccagcaccgagccgtccatccggatgactccggctcggcgggtgcgcgggtcgttgaagaagacctggccgtcccgggcgaccagctggaagtcggccgccggccgcagaaccgtcggctgggccacgacgctgccggtggccgggtcgacgacgaagacgcggccgtgggcgggctcggggacgaacagccggccgccgctctcgacgggagtgcccagccgatcggtcgcggcggtcagggtgatggcctgcgagcagccgtcggcgttcaggtcacacacgctgacggtgccccggtaggccgggtagacccgggcccggccgggtgagccgccgatcgccgggtccggctcgccgcccagctccaggcggaccgtcgtggtggtcttgccgtcccggtcgagggcgtacgcgttgccggtggccaggtcggccaggaccggcttgccgccggccagcaccagccggcccgcgccgggggtcacggccgccggccggacgatccggcggtcacgccggacggcggtcaggttcccggtgcgggcgtccagcgcccacaacaccccgcgcgcgtccagcacggtcgcgcccgggtcggtggccgccgccagcggacgcggccggccccgcggcgcgagggtcgccgggtccaggtcggcgagcaggccgtgcgcggtgtcgaccgcgtagagcacgccgtcgccggcgaagatccgcacgccggtggtcgcgcccgggacggcgccgaccgccggcgtggccgtcatcgtggcgccgtcgaccctgcggactgtgccgtccgccgtgtccagcacgtacgcgtccgcgccctgctggaccacgtcgaagtcgtgcgccgccgggacgaccggcacccgggcggcgacctcggtgttgaccccgtcgagcagctccacctcgccggggccggtcgacggcagccaggccgagccggtcagcaggtgcggggcctgggccggatagccgtgcccggcgccgacgacggccatggtgccgacgccgaccacgccggtcaggacccgggcgccggcggcgaggcgacgcgcgaaccgcctcatcagttgctccgatcgcggatcagaatcggacgcgggtcgatccacgcggccatggtggcgggcagtccgcgctcgcggcgcagcgcggaccgcagggcggcgtcggcgcgccacgcctcctccgcggcctcggcggcgggcggttcggcggcgtacagggcggcgccgaccaggggcgccagcgtggcgaccggcgccgtggtgtcgccgaggcggcggcgggcgtggtcggcggtctccaggacggtccaggcgcggtggatcggcacgccggcctcgcgcagccggtcggagctctcccgccaggcgccgctgatgcgctgggccggggtgccgcgacgacgcctgcgggtgcgccgctgcttctcggcgacgaccaggaccggcaacaggatggcgagggcgacgagggcggccgccacgatcagcgcccagtcccacggcgacagctgcacgggcgcggccaggtcggggcggaccaccatgctcggtgcgacgtcgcccggccgcacctgcggttgcgacttcggcaccgggttcggcggaggcgccggggtgtggcggttgtcggggttggtggggtcgaacgccatccagccgtatccggccatgctgacctcggcccaggcgtacgcgtcggtggaccgtacggtgtagacgccgtgcgcgggtgacctgcgccgcagcaggtagccggtcgccacccgggccgggtaacccagtgagcgggccaggacggcgaacgccgccgcgtgctgctccgcgtatccggccacctggttggtgccgagcccgaagagcccgcgcagccggtgcagcgagtgaccgggcggggtggccgggtcgtagcgcaacgcccgcaggcgcgtctccagcgcgaccagcctcgggtagtcaccggccgtgcccgcagtgagcgtctgggcctcctgccgcagctcgaccgggaagtcggcgggcagcgcgaggtagcgcggggacggcacgaacggtcgcgcggtgcgggccccggcgtcccgcgggcggacggtggcgaccaggtcgtacgagaggccgtgccgatccttcgcgggcgtcgccagcacaccggacgcgacggcgtacccgatgccggatccggtgatctgttccggccagccggcctcgggcaggtacggctcctccagcgcgtcgatccgcacgtgcagaccgacctggacaccgtggggcgttcccggaccgggcgccagctcgtgcccggcgagcaggaaccggtcgtgggaggtccactcggcgccgtcgtaggtgtccaggacggccgtgcggacccggtccaggcctgagccccggaccgtgaaaagggtggggggattcttctcccgcagccggctcttcagcgcggccagcgggttgatcgtgtcctcgatcgtgagtggcaccggcaccaccgtgcgcgggtcgaaccgctggtgcccggcgatcggcgccaccttcgcgaaaccggttcccgcggccacgaccgccaccaccaccggcagcccgaacagcgcccggccggccagccgggacccgccctcggcgccctcggtccggaccgcgcggatcagcacctgggtcagcccggccaacagcatcaccgcggtgatcgtcatggccccggctgtccggccggcggtcagcggcagcgcggcgagcagggcgagcgggggtacggccgcgggcgcgaacagcgaccgggtacgcagcgacagctgagcggccgcgaaaccgcacaggtagaggaccagcgccggcgtgatcagcaactcgccccggacgtccgcgggcacgcccaccgtgagcatccggatccagccgaaactcaccccggtgccgagcgtgctcagggtcgtgccggtcgggatgccgtagcgcagcgtgcccggcagcacggcgtagacggccacgaccaggaacccgccggtgacggccaccgcggtccacgcgtgccgcaggtgggtcagcgcggcgagcacggccatcgtggcgccccccgcggcggcgaccagcagcggcagcaggtagccccggccgacgaagaaggcgccgtagaccggcgcggtcaccgcgacggccgcggtacccagcgcgatctcggcttggtgcagaggaccggttctcatcggcgtaccaactcgttccaggcgagggcgaattcggcggggctggtcgcggcgaccgacacgacgccgggcagccgcgtctcggcctggaaggtcgcggcgaactgcaccaggctgagcatcaggaaccggggtctgatcatcgggagcacggccagctcggcctgggcgggccggccggtcaccacgcccagcgagacggcgctctgttcggggacgagcgcgggcagcgcggccaggccccggtcggccgggtcgaggcggacggcggccagcagatccagcacggacgtgcggcccggcccgtcctcttccgcgacggtgacctcgccgccggtcgtacgcagttcgagcgggaacccggcgcgcagcgcggccaccgacagcgaggcggcggcccggaccgcgtgttcgaacgactcgtcgtcgtaggcggccacgctggtgtccagcacgatcatgaggcgcggctcgttcgggaccacgttgtgccgcaccatcaactggccggtacgcgcgctggacttccagtggatgagccgccagtcgtcgccgggcacgtactcgcgaaggctgtggaaggcgattccgccctgcggcgccacgctggaggtcggcccgtcctggtcctggctgcgaccggtcggcagcgggtacacggtgtcgaccagcgggtgcacccacagcgtcgacacctcgccgaaccgcttggccacctccatcagccgcagcgggtcggcatgcccgacggtcagcggcccgacctggtagacgccgcgccggtcggtcggcaacgggtagccggacaggtggctctcccgggcggccaggctcggcaccggcacccccacgctccggccgtccaccgactcggtcaccgagaccggcggggagcggcggttcatctggttggtcacggtgagcacgccgaccgcctcgtcgccggcggtcacccggttcggccggatctcccgccgggccaccagctgggggcgggccagcatccagagcccggcggcgagcagggcgaacagcccggcatagccgagcacggccagctccgggtagcccagcacggcggcggcgacgagcagcgccacggcggcgacggccaccgcccatccgctgcgggtcagcaacgggtcaccgggccgtcgccgtctgcggcaccggcacggcggcgaggatcccgtccaggaccgaggcggccgtggcgccccggatcgccgcctcgggggtcagcacgagccggtgccgcaggaccggaacggccatcgccttcacgtcgtcgggcagtacgtactcgcgtccctcggtcgcggcccgggcctgggccgccatcgcgagcgcgttgccggcccgggggctgccgccgaggcgcacggtgtccggctggttgcgcgtaccgccgacgaccgcgaccacgtacgcccggatcggctcggccacgtgcaccgtgcgcgcgacctcgatgaggcgcagcagctcctcggtgtcggtgacggcgctgagctgctcgggcaggcggcggtcgatcgcgtcgccgatcacccgcatctcgtgctccggcgccgggtagccgagccgcagctgcatcatgaaccggtccagctgggcctcgggcagcgtgtaggtgccctggtggtcgtacgggttctgggtcgcgatgacgaagtgcggcgcgggcaggtcgtaggtgcgcccgtcgaccgagacctgacgttcgcccatcgcctccagcagcgccgactgggtcttcggcgaggcccggttgatctcgtcggcgagcacgatgttcgcgaacaccggaccggagtggaactcgaagcgctggttggccgcgtcgtagatgttgacgccgaccacgtcggtggggagcaggtcgggcgtgaactggatgcggtgcacccggccgccgatcgagtgggcgatcgccttggcgagcgtggtcttcgcgacccccgggaccccctcgatgagcaggtgcccctcggcgagcaggcaggtcaccgcggcgcggaccacctcggtgttgccgtgcaccacgtgctcgatgttgtccacgagggctcgcacccgatcgcggacccaggacaggttccccgtccccgactcgcccggtgccgtcattcgtaccctccaagatcttttgagatgtcgtccttatttgaacggagagttgcctatcaactaccctccgcaacacggcacggaaggatggatcacggcatgttccctctgggggtggacatcggcggcaccaccgtcgccgcggccgtctggcgtcgcggccgcgccgagcaggcgttgctcgccgcccgccggcccggccgggacaccgtcctgccgctgctcggcaccgccgcgccggtgctggtccgcggcgtgccacgggcctagctagctagcggcggggggaagtccgcgagcccggcccgggacagcagctccagcacgtcgcgccgggtcgcggtcatcggctcccgcgcgacccccggtgccgccggcgcagctcgccgggtccgcgatgccgccgccctgtacgccttcggcgccagcggggcagctcgccggggccgcaatgacgccgccccgcgcggcttcggcgccggagtccggcgggggctcggcgccggagtccggcgggggctctacgccggagtccagcgggtgctcgacgccggagtccggcgggggctctacgccggagtccggcgggggctctacgccggagtccagcgggtgctcgacgccggggtccggcgggggctcgacggccggggacgccggggtccagagacctcgacccggaccgtcgccgtaggcggtcgccgccgcctgggcggtgcggcggtggcgcaggaagcgggccaccggctcggcgtgggtcgagcgccacgcggagaagtcggtcccgccgccggacagctcgaacgcggcggcggcgcagccgggcgggtcggtcaggtcgtggcgggcggcaaggtcggggaaggacgccgggtcgatcggccacaggcctggaccctgcgggccgacggcccggctgtcgccacccgactcggccagggctatcgcggtcatggtcgcggccgcgtccggtccgaacccggcgcggcgcgcgagggcgtagagctgctccgcggcgaactgggccatgcccggataatacgtaattagtatctttcgaggtaatcggccgcgacttgcggcattgcggcgggccggagcgcggcggggacgtatgcatagccggtggacgacgcaccggcgtgggaggttctcgccgacaccctgctgcagcgggaagccctgatctgccggatcgccgagggccggccgccgcacgactccgccggcctctacccgggacgcgacgacgacctcgaccgggtgctcggcggcctgcccggcctcgacgggccgggcagcgccgccgccgactccgtccgcgagcacctggcgccggagctggagcgggcccgcaagctgttcaccgaggcggtcgacgccggccgggacgtgttcgcgctggtggtgcaccgggccgggctgacgctcgccgaggcgcaggtgctcgccgtgctctgtgccgtggacctgtccccggcccggatgcggctggtcacgtacgtgcagaacgacatccggctcccccgtcccacgctcgccaccctcgcccggatgaccggcgacgccggttcgctgtcccccgacgcacggctgcacaccaccggcctcgtcgagaccccgcgggacggcccgtgggcacggcgttgccccgtccccgccgaccgtctgctctggtcgctgcgggggatcggcgatccggacccggacctgccgcacggcgcccgcctgatcggccggaccgcggccacgcggccgaccgcccccgttctcctgctggccgccggccgggacgccgagacccggacccgcgccgtgatcgaccgctgcccgggccggggtctgctgatcacggccccgccgcagaccgacgccgcctggtgcgccgtggtccgggaggcgaccctcggcgaccgggtcgtggtgctcgacctccctggcgagccgggcccccgcgcgggtcacgagatcctgcgcgccgcccatctcagctgggctctgacctccgccgtcgacctgccgctcgccgccctcccccgggccctctgggaggacctgcccgcagccgatccgcacgccgacgcgggcgactggtcggccgccttcgggacggcgccgggcgggcggctgacgcgcgaccagctcgggctcgtggtggcggcggccggcgggaatccggcgcggctgccgcaggcggtgcggcggctcgccggtgggcacctcgatcacctcaccacccggttgcgcccgcgccgccgctggtccgacctggtgctgccggaccggcaggcggcccgcctgcgcgaggtgatcacccgctaccggcgccgtgcggtcgtctacgacggctggggcttcgcggcggtcccgtcgaccggtgtcgtagcgctcttctccgggccgtccgggaccgggaagacgctcgccgccgaggtggtggccgccgagctgggtctggacctgtaccgggtcgacctcgccacggtggtcagcaagtacatcggggagaccgagcgcaacctggaacgggtcttcgacgcggccgccgccggcgagctggtgctcttcttcgacgaggcggacgccctgttcggccggcgctcggaggtgaccgacgcccgcgaccggtacgccaacatcgaggtcgcctacctgctccaacggctggagaaccaggacggcatcgtgatcctcgcgaccaacctgcaccgcaacatcgacgacgccttcctgcgccggatctcggtccacctcgacttcgagccgcccgacgaggcggcccgacagcggatctgggagctggccttcccgagcggcgcaccggccgacgacctcgatctgccattcctcgcggcgcagttccgggtcaccggcggcaccattcgcaatgccgctctcggggccgctttcgaagccgcggaaaacgggacgacgataaccatgggccatgtcgtacgcgccttgcggcgcgaattcgacaagatgggccggctgtgcaccgaggccgatttcgggcgctactacgcactcatcgacttgacctgaggccggaacgatgctggatctgctcgacgaggcgctggagagctttctgcgtgcggcggtgccgctcggcgcggacgtggcggtctccttcgacgcccccgaccgggactgggccgcacggctgtccggccggccgacggtcaacctctacctctgggacgtgcgccgcaacctgggcgagcaggaggccggcgaggtgctgaccaccgggccggacgggcgccggacgcggcgcggcgcgctgccccgggtcgactgccgctatctggtcaccgcgttcaccagcgaggttcgtgacgaacacgccctgctgggccgggccctggccgcactgctgcgggagaccgagatcgacgcccggctgctgcccgagccgatcgccgcggtccgcccgctgccctcggtacggatcgcggcgagcgacggccgggacaactcggacttctggtcggcgctcggcggtcagctcaaggccggactcgacctgctggtgaccgccaccatcgacgccgtcccgctgccgcagccggccgggcccgacgtcgtacagcgggttctgcgcctgcacgacaagtccgccgcaacgctgctggaaacgataaacctcccgaacgggggaaccgacgagtcgctgccgggggccgcggtgccattgccggaataatgatcaccgaaacgccggaaatccccggcggacgtttctttccgcgactccgtgacgatgggatcgagcatgtccgtgccggtcctgcccaccgtcgagccggacgaggccggccggacgacggtcccccggacggtcccggcctcgaccgccggagcgcccacctcactgatcccggacgtcgtgctcgacgggatccacgccgcggtcaccgcgatccccggctacccactgctcacccaggtgatcggcgtcgacccgatcaccggtcacgcggtcaccacggccccgcagcagctcgtcgagtcggtgctcaccggtgcgggcccgttcggcgcggccaccggccgggtgctcgccgcggccggggtcgtcgacgaggcgctcgccgcgatacacgtgcggctggccgcgcaccggatcaccctggcccgcatcggcgacgagatcgccgccgcctgggcggagctctcggtgaccgcgggcatcgacggcaacgcggccatgctcgggcgccacgtcggcggcatggtcgccgacgtccgggccgccgtcgccgagctgatcgagaccgtgctgtccatggtccgccgggtcgtcgccgacctggccggcccgctgctgcagcgacccggggtgcggccggtgtgggagctggccacccaggtcttccggtacgacccgttgcgcggcgccgaggtgcgggtgccgaccgtcgagatcctcaccggcttcctgaccgtgatcggccgcgagcagaccatcgaccaactgcgcgaacgcggcgtcctgcagtccgccgccgactggctcgacacccgcctggagacgttcgccgggatccgcgacgacgcggtgcggctgttcgccgacgcgtgggccgccctgagcccggagagcctgccccggctgctcgacacgctcccgcagctcgccgagcgggcgatcaccctgatccggcggatcctgtcgttcggcgccgacctgctcggcaaggctctcgcactggtcaaggacgcgctgcgcggcgcgctcgcccagcgggccgcccgggtgccgggttatccgctgctgaccgtgctcatcgagcaggatccgctgaccggtgcgcgggtaccccgtaccaccgcgtccctgatcgaaggttttctgggccttctgccgggagtgggcgcggccgccgccgagcgattggccgaggccggtgtcctgaccgaggcggcggcccggatcgaggccgaggtggcccggctcggcatcggcgcggacatggtcaccgggctgttccacggcatctgggactcgctggaactggccgacctgctcgacccggccggcgcatgcgagcgggtggtggcccgattcggcgagccgctgggccggctggtcgcgttcgccacggtcgtcgtcgaggtgctcatcaccaccgcgctcaagctcatggacttcccgcccgagctgctcacgtcgatcgtcgccgacgtcgccggcgcgctcgccgacatccggcgcgacccggtcggcttcctgctcaacgtggtgcgggcgctgcggctcggcttcgcggcctttctcgacggcatcgccgggcacctgctgcgcggcctcggctcctggctgctgcgcggcctcgccgggctcggcgtagcggtcccggacggcccgatgaccacctcggccgtcctggacatggccatgcaggtgctcgggatcagcgccgagaccctctgggagaaggtcgccgtccggctcggccccgagcgcacagccgcgctgcgcaacggcacggcccgcctgggcgaggcctggcaattcgtcaccgacctccgcgaccaggggctgagcggcatcctggcgcacctcgcggaccgggtcggcgcgctctgggacaccctgatcggcctcgccaccgactggatcatgacgcaggtggtgcagcgggccgcggccagattgctgtccatgctggatccgaccggggtgatggcggtcgtcaacgggtgcgtcgcgttcttcaccgccgtccggtccgcgatcgagtacctgcgggacatcctgcggatcgtcgagggctacacgcgcacgatggcccggatcgcccgcggtgagctgacgcccggcgccgaacaggtgacccgggggctggccgacgccgtcccggtggcgatcggtttcctcgccgcgcaggtgggtctgggcaacgtgccggagaagctggtcgagctgatcgagagcctgcgcgccctgatcgaccgcgcgatcacctggctcttcgaccaggccgtccggctcggcagcggcgcgctgaacgcgctgcgcggcgaggcacccggtgcacccgcagggcacgagggcggcactcagctggccgagctcgccttcgccctgccgttcccggtcgggcccgaggagcacgaactgatcgcggacgtcgaccctcgacgcctcgtcgtccactcgaccccgacgacgatcacggatctcatcgccgccaaccccgggaccaccctgcaggccgaccacgatcgctatgtggccgcggtggacgccttcaagcaggcactcgacgagcgggcacgaaccgggtccgacgccgcgtgggccgacgccgagaagacggcgaagaagaagctggcggcggtgaagaaggccatggagaccctggtcgccaccatcactccgctgaagggcttcgacccggccgtgcccggcacgagcgctccgggaatcggcaccgaggcgtactgggacgggaaccggccgctgagcctgcagaacggctcgctcaccgcccaccggatctggcacctgaccgccgagcacgtcatcccgttcgacctcggcgtcaagctgtggaacgcggtcgccctcggcgcgcccgaacgcgacggcggcaaggaggtgacgtcgcagcggatcatcatgatctatcgcggcgcgggcgacctgaagacgaccaggagggatccggtcaccggcttcaccgaacgggagatcagccggctgttcggcagagccgtcaaggaagccgactttcccgcccgggtcagatccatcggataccgggacgacggtcccgtgccgggcgcagcgacccaggccgagcaggccagaagggaactgctcgacgccatcgaccgcgccatgtgccaggccacccaggtgtccgtgggccgaacccggtgggcggtcgagaccgagtgggcgtcgcgggggaacggcttcgccaccaccaacggccagcggcgcggcgagagcgcgccgacgcccaccggaagtcagatcgaggccaccgcggacgtgcagcgcagggacatcctgctcctggtcacccacgccgtggagcacgcactggaacaaatcgaacggagcgagtgatggcagtagggggtgctcccggtgtctacatcgaggagcaggtcagcggttccatgccgctgcaaggcgtcggcacgtccgtggccgcgttcgtgggcttcaccgaacggtacgacgcggcgcagggcgacgactcggatccggagggaatcaagccgcagctggtgacgagctggccgcagtacgagcggatctacggcggattcgctcccgggatcatgctgccgcacgccgtgcacgggttcttcgccaacggcggctccgcgtgctacgtggtgcgcatcccggtgcgatcggtgcgcccggcgcgccggtccctgcccgcgaccggccgggaggaggccgattcgctggtcatcgaggcgcgcgagccgggtgcgccggtggaggtgacggtcgtccacgagccgccggccgtcgagggcgaggcgccgcaggagttcagcctcaccgtggaccgggccggcggtcagaccgagacgtacccgcggctgacgttcggcaccggcaagggcacctcggccgcggtccgcacgatcaacgaacgatccacgctgatccgggtcgaggcccggacggtggcggggctgtccccggccgagcgtatcccggcggcgggcacctatctggtcgagccggcgccgtcggcggccacggcgaccaccggtgacctggccggatcggagaccgagcggaccggctaccacgggctggccatcgccgaggaggtctcgatcgtcgcgatccccgacctggtgaccgtggtccgccggccggacggcgggatcgaccagaccgcctatctggaggcgcaggcccggctgctggactggtgcgagcagcggcgtacgacgatggccgtgctggacctgccgccgggcctcacggcgcagcaggcactggagtggcgtgaccggctcaagcacgacaccgcgttcggggccgcgtactacccgcacctgatcgtcgcgaatccgaacgcccggcccggttcgaccgctgccgaccgatacctgcggatcccgcccagcggacacgtggccggagtgtgggcccgcaccgacggcgcccgcggcgtgtggaaggcgcccgcgaacgaggccctgcgcggggtggcccggctggagaccgaggtgaccaccggcgagcaggacctgctcaacccgagtcagatcaactgtctgcgctcgttcggcgccaacggcatgcgggtgtggggcgcgcgcacgctcgcttcacaggaccaggcctggcgctacatcaacgtccgccggctgttcatctacgtcgaggagacgatccggcagggcacccagtggtgcgtgttcgagccgaacgacgaggcgctgtggggccgggcgaagcggaccatcggcgcgttcctgcaccagttgtggatgcgcggcgccctcgtcggcgcctcgcctgagcaggccttcttcgttacctgcgacgagacgaacaatccgccgggctcggtcgacaacgggctgctcgtggtcgacgtggggctcgctcccgtcaagccggccgaatacgtcatcttccggatcagccagtggcagggcggcgtagccaccgccgagtagagaggggcagttccatggtggatctgatcaccacgcagaccttcgtcctcgagatcgacagcgtcgaggtgggcagcttccgcaaggtctccgggatcgagtcggagaccgagacgatcgagtacaaggaggtgaacaaggacggcaagatgatcatccgcaagcagccgggcgcgatgaagtgggcggacatcaccctggaacgccggatcgacgtctcccaggtgctctggaactggcgcaaggacatcatcacgggcgacgtcgacaagggccgccgcaacggcgccatctcggccaaggactccaagggcgacgtcgtggcccgctgggagttcgtcgcgggctggccgtcgaagtggaccggcgccgacttcgacgccggcgccaacgacatcgccaccgagaaggtcgtcatcacgcacgaggggctggtccgcgtcaaatgagcctgcacaccgagttcccgttcacgctgccgaagggctacgtcgacgaggagggcacgctgcaccgcaccggcgtgatgcggctggccaccgcccgggacgagatcgagccgctgcgcgacccccgggtgcgggagaacgagtcctacgccacggtcatcgtgctggcgcgggtggtgaccgaactcggcacgctgccccccggatcaacacgggagtgatcgagcggctcttcgccagcgacttcggctacctgcaggacttctaccaactgatcaacttcggggatcccgccgcgctcgacgccctggagcccggcgcccctttcccccgggtctcggtggaggtggtctaggccgctacgccgaaccggagctgtggcaggaggtcgcgtacctggcgtaccacctgcactggggcttcgacgccctgctcgacctggagcacggtgaccgtctgcgcctggtgcgccaggtcgccgacctgaacgaacgatcctgggagggaatccttgctgcccggtgaccaccgtgtcccggacccgccgtggaccggacggttcgtgctgagcgtcgacggcctggagatcggcacgttcgtcgaggtcggtggcctgagcgtgaccatcgaggtggaggagatcaccgagggtgggcagaaccagcacacgcacaagctgcccggccggatgaaatggccgaacctggtgctcaagcgtggcctcaccaacgccggcaacctcttcggctggttcacctcctgctcgggtgagggtttcacccgcaaaggcaaccagcttgacgtccgcaacggcgaggtcgccattcgtgacggccgtggccgtgccgtacagacatggcggttcaccgacgcgtatccggtgcggtggaccgggccgaggctggccgcgacctcccgggacctggccgtcgaggagttggaggtctgccacagtggtttcacgatggcggccggtcgctgaccggtcgcgccgcacgcacgcctcgccgctgatcgcggtcgtcccggtgcgccggccccggtggctggccggtgtgctgctgctgcggcggctgcgggccggacgtctgccgtccccggcggaccggatgccgctcggccgggcccggcagccggccggtcggcggccccctcgtcacgagccggcgcatgatcggatcgctgccggccgtggctgccggacatccgggattgatcgtccggccacgcccgcacggcgtgggccggggccgctgatcgaggtgggggcggtcgccgggctccgggtggcgggtggattcgcgccgccaccggagccggccttcgcggcggcggcgccctccggccctcgacgtgccctagccgccggtccggtcgcgagcggacaccggagcgccggccctcgacggctcgccctgtgcggtcgcgccgtgcccggtctcggccctagctagctaggctggcgcacgcccgcactccggtcggccggccgcgcttctcgctgcggtcggcgcacggtgcggccgacgccgacgagcgggcggcccgccgggacgaggccacgatgcgacggatcgtcgcgggtgacgtgccggtcgcgtccctgccggtcggccaggccgccgcggtgcccctcggcagcgcatcggcgcgccctctcggcgaccgccatgcgccgtcttccggcaccgtcgcgacaccggctgccggccacctcgccgccctgtctgccggcagcgtctcggcgctgccggtcggcaccggcgccgcggcgatgcccgccctgatcgaggcggcggtccgcgccgccgaggaggccgcccgagcggtcctggacaccgggacagccgggacgcccggcctcccccccgacctgggacaccggcccggtcctcgccccgggccgccccaccggcacaccggccgggccggccgacccggccgcggcggtcgtcgaggcggcgccggttcccggcccgaatccgggacacgaaccgggcgcccgcgaacggggcgtcgacgagatcatccgcgcggtggaagagcgggtcctggaccaggtggagcgtcgcggcggccggttctcgtcgttgttctgatcaagaggggaggagggagagcgtggaccagcccgccaaggcctacatcgaggtcgagcgcaccggcgagcggatcgactgcctgttcaacccggccgagctgaccgtcgtgaaggcgaacacctggcaggccggggaagcgaagggcgtcgacgcgccgctgctgcggttccaggccggccagtcggcgaccatcgcgctcagcctggtgttcgacaccaccaggacgggaggcgacgtaacctcgtacacctcgaaattgttgaatctgctccgggtcgatcccgatctgccgtcgaacgacccggcgcgcgcctccggccgcccgccctgggtgaagttccactggggtgagctgcacagtttccgcgcggtgatcgaccggctgcaggtgcggtacacctacttcgcgtccagcggacggccgctgcgcgccaaggccgacctcaccctgcgccagcttcaggacgagcacgagcatcccctgcagaaccccacgtcgcacacccccgcgccgcactccgtccacgtggtccggcccggagagacgctcgaccggatcgccgccgcgcgatacgccgatcccggccaatggcggctgatcgcggcggcgaacggcgtcctggacccgctggatctgccggccggcacctcgctggtgatcccggagaggccggtacgccgtgaccgctgaccgggggctcgacaccgtggcgatcaccgtcgacggtgcgccgctgccgacctcgctctatccccggctgatccgggtccgggtccaggagtcgatccacctgcccgaccagttcacgatccggttcgaggacgcccacttccagctcttcgaccagcaccggttccgtcccggcacacgggtggagatcgcgttccggtccgacgccgacccggtggtggtgacctccggggaggtcaccacggtcgaggtggcgcccggcgtctccggacgtcacgagctggtgctcaccggcctggacctggcgcaccggctcgcgcgcggcccgcggacccgcagtttcaccggcatgtcggacggcgatgtcgccgcccggatcgccgccgaccacggcttggacgccgatgtggacgcgaccggcgccgcgcaggactacgtgctgcagatcgccgagaccgacctcgcgttcctgcgcgggctggccgcccggaccgggttcgacgtctgggtcaccggtgggacgctgcacttcaagcgccgcccgtcgagccgggtcacgccgcccccgatgcgctggggcgacaacctgctcgacttcagcgcccggttcgcctcggccgagcactgcgacgaggtcgtggtgaccgcctgggacccggtggagaagcggacggtgaccggacgggcggccgagccggagtacggcaccgacgcgccggccgccgcccagtcggcggaggccgcccggggcgcgttcggccgtaccgtccgccggaccggacaggtgccggcgagcgggctggccgaggcggaggcctacgcccgatcgctgttgtcgaaggcctccgggtccgaggtggtgctgcgcggcctcgcgaagggcaacccgctgatcgcggccggggcccgggtgcagctggagcgggtcgggcagcggctggccggcggctaccgggtgacctcggccgagcacgacttcggggccggcggcccgtacctgaccaggttcgtctgcggcacccgggacgcgggtgagctggccgacctgctgcgcccggcgcccggcgccgagccgcggtcgctgatcagtgccgtggtgacctcgaacgccgatccggaaaagctcggccgcgtacgcgtacgcttcccgaccctgtccgagcaggacgagagcgcctgggcccgggtcgtgacgccgggaggcggtccgggccggggcatgcagtggctgccggaggtcgaggacgaggtgctggtcgggttcgagctcgatgaccggacccgcccgtacgtcctcggtggtcttttcaaccgccgtgacgtgccgccggatccggacgtggcccgcgacggcgcggcgacccggcgggtgctcgcgagccgctgcgaccaccggctcaccttcgacgacgacagccccggcgcggtggagctggcgctgtccgggggcgactcggcgctgcgcctgaccggggacgaatcggcgctgcgggtcgccggcgccctgaaggtcaccgggcgcacgatcgagatcgccgccaccgaccggctcgtgctgcgcgcgccgaccgtcgagatcaccgcggacgccgagctgcgcgccgccggccggccgatccggctcaactgagacctcagggagagacacccatgccgaacgcggcccgggagggcgacccggtcaccgggaccgacacccacctcgtgctggtgcccgggccgggcgggccggtgcccgtaccgcagccgctgcccttcgccgggacgctcgtcagtgggctctccccggacgtgctgatcgacgggcgaccggccgccgtcgtgggcagcggggtggtcaacagtccgggacacctgccggtcccgcccggcacgggcttcgtcaacccgccgctcaatcggggcaccgtactgagcggctcgctgaccgtgctggtcaacggcgcgggcctggcacggctgggcgacccggtgacgacctgctgtgacgtcccgggtgcgcccgccacgatcaccgcgggctcgccgggcgtggtggcgggatgagcgacctgatcggcgccggctgggcattccccgccggggtgacgcccgcgggcggggtgcgcctggcccggggcggcgacgagctggacggcgcgatccgcatgatcctcggcaccgcgccgggcgagcgggtgatgcgcccggacttcggctgcgcgctctgggagcaggtcttcgcgccggtcaacccggcgacgctcgggctgatcgagcaggccgcccgggaggccctggcccgctgggagccccggatcgtggtcgaggacgtgaccgcctccgcggacggcgaggccgccgtgctggtcaccgtcggctaccgggtccgggccaccaatgaccgccgcaacctggtctacccgttctacgtgatccccggtgaggagccgaccgagtgagcctgcccgcgcccgacctggacgaccgcacgttccaggacatcgtcgacgaggccaagcgccgggtcgccgccgcctgcccggcgtggaccgaccacaacgtctccgatcccggcgtcgcgctgatcgaattgttcgcctggatgaccgagatgaccatctaccggctgaaccaggtgccggaccggctctacctcaagttcctcgaactggtcggcatcacgctcgcctccgcgaccccggcccgtaccggcctgctcttccgcctcgatggaccggctcgggacacggtcgtcgtcccgcgcggcacccgggtcggcaccgcgcgcggccgcgacggtgaccaggtcgtcttcatgaccgacgcggacctgcgggtcactgtccccgaggtgatcgcgtgccggaccaggaccggcgggaccgacaccgaccacaccggtgagctgcgagccggggaggcgcgcatcgcggtcttccccggggtggccgccggcgacgcgctctacctcggcctgagcgcggaccacggcggcaacctgctgcagctcgacctcgccgtcgcgggcgcgcacggcgccggcatcgacccggagcacgccccgatcgtctggcagtactggaacgggggcgggtgggaggacgtacgggtactcaccgacacgaccggcggcctgaaccgccccgggaccgtcgagatgctgatcggcccggtgcagggtgagctggtgatcgggggcgtgccggcgcactggctgcgctgcgtgctgcgcccggccgccgggcagaccggataccggacctcgccgatcctgcggtcggtggcgatcgggggctacggcgggctggcgccggccctgcacgccgagcccgcgccgggcgagctgctcggagtcagcgacggccggcccgggcagacgttcgtggtccgccgcgcacccgtgctaccccgggccgacggcgagaccgtgctggtggtccccggcaacggtgccggccaacccgaggagtggaccgaggtggcgtcgttcgccggcgccggaccggacgaccggcatctcacctggtgcggcgccaccggcgagatccggttcggcccgcgggtcatcgaccggcacggccaggcccgcagtttcggagccgtgccgccggagaacgcgcagatccgggtcaccggataccggttcggcggcggggcgcgcggcaacgtgggcgccggaaaactcacggtgccgctctccgccgtgccgcagctgcgcacggtcaccaacccggaggccgccacgggcggcgccgacccggagaccacggacaacgcccggatccgcgggccgctggcgctgcgcagcgccgaccgggcggtcaccgcggccgacttcgagcggttcaccaccgaggtctccggcgtggcgcgggcccgctgcctcccgccggacgagccgggcgggccggtccggctgctggtggtgccggcgaccgcgcggtcgccccggcacctcgggctcgacgatctccgactgccggaggcggtcggcgaggacatccgtcaggagctggacggccggcgcctgctgagcgtgcgggtccgcgtcgaggttccccgctaccagggcatccgggtcagcgccggggtacgggccaccgccacggtctccgcggacgtggtcgggcaggacgccgaggacgcgctctaccggttcctcgacccggtggccggtggtccgggcggtcacggctggccgttcgagcgcgcgctcggggtcggcgacatctacctggtcctgggcgcggtgccgggagtggccgccgtgacctcggtcaatctcacgctgaccgatctgtggggtgagcgcgaggacgctcccgggggccaggaggtaccgctcgtaccgtccgcactcttcctctccgaccggcacacggtggcggtggcctggtgacctggctgctcgcccaactgccgcagacgatggcccgtgacccgttcctggccgggttcgtcaccggttgccagcaggtggcggactccgtccgggcccagatcgacgacctggaacacgagctcgacgtcgacctggcctcaccggagatgctcgcgtacctcgggtcctggctcgcggtctcgctgcggccggccaccaccccggccgagctggacgaccagcgtcggctgatccgcgcggtcggatcggtgatcgggtaccggggcacctgttacgggctcgaacgcctgctgagcgcactgaccggggcccacgtcacgatcggcgacccgggcggggtggcgttgcccggtgaaccggaccggccgggtggtgacgtacggatcgagatgtccggcaccgggaggtgtgacgtggcccaggtgcacgcggcgatccgggaggagctgccggtcggcgtcggctaccggctcgtcgtggccggccgggagcagtgatgcggcgcctgcgacgcggtccccgcgtttccggcccgcgcgtcttctccggggacatgtgatggagccggacgatcggatgttgcgcctcccccggaccccgggacaggaggcggacacgggtggccggagcgctgcccgtgacgaccggctgcggccaccggagaagcgcgtccccggcccgcgatgccccgactgcggtcacggcaaccccacggcccgggtacggtgcgaggtgtgcggcgcggagctgtggcccaccgccgcgacccggccgtcaccgccgctcgcgccgcccgatccggccccgaccgtgtcccccgaccgccgcccggcgctggtgctgctgctcgtgccgctcgcggtgacgggtgcgatcttcctcctggcgtactttctgatcaggcactgatggcccggtgagcggcggcggcctccgctcctgacccgggccggaaagggggcggggtggccgggtcgcccggatgacaccatgatcggcatgaccgccgacgaacacgccgcccgcgccgccgagctcatcgacgaggcggagcgcctctaccagatctgcctcgtcgactatcacaccaacatcaacgaggacgatcactccgaggagccgtacgtgccgggcgcggacctggcgatgctcaccgccaccacgcagctcgcccaggtccacgccactctcgcactgcgcggcccggccgccgcgaacggctgacacacgccggccgccgcaaacggctgacacacgccggccgccgcaaacggctcacgcacgccggccgccgcgaacggctgacacacgccggccgccgcgaacggctgacgaccgccggctgacgaccgtaccgagtaatcgatggtgcccttgatcttgtctcatataaagatcatctttatattgggcggcatgacggaaccgatgcgcgaccccagcttctgggttctcaccgccctggcgcccgagccgcggcacggctacggggtgatccgggaggtgaaccgactctccgacggccaggtgacgttgcaggccgggaccctgtacgcggccctcgaccggctcacctcgctcggcctcatcgaggcggaccgtgaggagacggtggacgggcggccgcgacggtactaccggctgaccaccgacggcgccgccgcgctggacgccgagacggagcggcggcgggcggcggtcgccgcggccaccgcgcagctgtcggcgcgccgccggctcgggctgagcctgagcacctcgtgagcgagcggctggcccgccggtatgcccggctgctccggtgctatccgcccggcccccgccgcgccgagatgctcggcaccctgctggaatgcgcgccgcccggacgcgaccggccgaccgcggtggacatcgtgaacctgacccgttacgggctgcgggcccgcctcggccggcccgcgagcaccagcgtggtgctgctgtccctgctggtcgcgctcgtctgcgggctgctgggcgcggccaccggcgcccgcctgggctggatgctgcagaagccgctgccctcgggggcgcaggcgcgagagctcacgacggccgccttccccgggctgccggtgctcggtggcggcgacgccccgccgttcgtaccggcctccggcgcggacggcggtgaggtctacggcttcgccgagtactgggtgcgcaacaccccggagacccgcgacgtgccagcctacaccagaggcgtccgggaccggctggccggtgcgggctggcagatccgcgacgacgtcaccgccgagcaggacgacgagcaagcgtcgtggagcgccgggttcaccgccacccgggacgacctgatcctgaactacagcgcctactacgtgaaggaccacccctggtacgactcggacggctcggccggcttccagttgtcccgcacgacgccaccgtggccggcccggttcgcggtgccggccgggctgctcgcggcatgcgccggctggctgctgttcggctgggcgagccgacgcagcgagggccgtccggcccggaccagaggcgccgtcctgctcgtctggtcggcgatgctcgtggtcgcggcgagtctgtacttcatctgcctgtggtacacccagcccgggccgctggagggccgcccgctgtggacgaccctggatcagctgtccggggcacccaccacgctggtgttcggcctgggcatgctggcgctggtgacggccgccctgccggcccggcacaggatcctcgcggcggcggcgctggtgctgttcatggtggtcgccatgaacggccggccgagctggacacgaccgggatgcaccccgtccgggccgcccgccgcgctgccggccgccgaggtggccaccggcctgacggcccgcgtctacgtgaccggcgacgcctccgccgaacagcgcaacatcgcccaggccgcgatctggcatgtgccgtccgtgcggtccacggcctggtccggcgacgtgaccgaccaggactaccgcgacgcgtactgcggcggcggccggatcaccggtgcctcgcgggcgacgctgcccgggttctggctggtggagctgagcagccccggcgggttcgacggcctggtggccgaggtgggcggcctgcccggggtggcggccgtccggcactccgccccctgaggaccgggaccggaccattcaggcggcggtgacggtcagggtcagctcgaacgtcgccccggggacgggccggtccgccacccgcaggattcccccgagctgggtggccagctcccgcgcgagcgacagtccgaggccggcgccgccggcgtgccggtcccgcgcggcgtccacccgggtgaagcggtcgaagatccggtcacggtcgcccgggtggatgcccgggccgtcgtcggcgacctcgacccgcagccgggtccgcccggcggcggccgggtcggcggtgatccggatctcgacgcgccgtccggcatgccggacggcgttgtcgagcaggttgcggacgatgcgttcgaacgggacccgggcgagccgtaccggcacgggcgggccggcggggccggtcaccgtgacgccgtcgcgggtgatggtctcgaccgccatccgggacagcacggcgacgacgtcggcgtcgacctccggttgcggtggcgcggtgcccgcgtccaggcgggccagcaggagcaggtcgtcggccaggccggtgagccgctgggcctgggccaccgcggtcgccgcggtggccggccagtccgtgcggtccggatacgcctgggccacctccaggccggcccgcaggatcgccagcgggctgcgcagctcgtgggcggcgtcggagaccatccggcgctgggcccgatcggcgcgctgcagccggtccagcatggcgttgatggtggtggccagcgccgcgatctcgtcgccggtggccggcacctcgacgcggtcggcgagccggctggcggtgacctccgccgtccgggcccggatggcctccacggggcgtaacgcccggcgggtggcgaaccacgcgaccagggccaccaccaggacggccagcgggacggcgccgacgaggatccggtcgacggtggccaccgcccgctccgcggcgagcggggtgacgaacacgtagacggcgaacgtcggcccgagttccgggtggtcggtcatgctgacgggggcgccctggatccggacgccggtgacggtccggccgtcgagggcgtggtctccgggtgggtcggccagccggaccgtggcggagacctccggcgtgtccatcgaaatgtcgccgggcagcgggtccgccgccggcatgacggcccgcccgtcgctctcgtacggggccaggtcggggctggccgagagcaccgccccggtggtgtcgaccacctcgaaggtgacgtcggggtagaaggcgggccgcagttcctccgcgccgcccgtcccgatcgtggtcgccgccagacccatggcgttgacctgctggacggcgctgcgccggcccgcttccagctgctgctgaccgacgaagtgccgggcccacagtcccccgccggtcagtatcacggcggccgccgcggcggccgccagcgcggatcgggcgcgcaccgaccgcaggccggtcatgccgccgcccggtcgtcgacgaggcggtaaccggtgccccgcaccgtacgcaggctgctgcgcccgaagggcagatcgatcttgcggcggagccggccgacgcgcacctcgaccaggttcgggtcgtccacgtcctcgggccagacctgacgcaggatctccagtttggtgaccggctcgcccgcacggtgcgcgaggaggtccaggatcgcgaactcgcggggggtcaaggtgatcggcaccgtaccgcgccggcaggtccgcgcggcccgttccaggacgaggtcgccgacggtgagccggaccgggacggcggccggaccgcggcgcaccagcgcccgcagccgggcgaccagcaccgggtaggagaacggtttgctcaggaagtcgtcggcaccggtgtcgagcgcctcgatctggtcgtagtcgccgtccttcgcggtcagcaccaggatcggggtgcggatcccctcacggcgcaacgtcgcgcagacacggtagccgttgagtcccggcagcatcaggtcgagcacgatgcccgcgtagtcctcgaagcgggccaggtccagcgcgacccgtccgtcaccggcgacgtcgacggtgtacccctcggccgtcagtccccgttgcaggatggtcgccaactcgggctcgtcctcgatcaccagcaggcgcatggcgtgcagcatcgcatggcgccggatcgtttcctgatcgctcggtcaggtcgggtcaggtacgggtcaacccgcccggcgcaggatcccgctccatgatcgtcctcagccacgacgtggtcccggcggcgcgcgccaccccggtgcgccgctccggcgccgtgctcgcctggtccggcgccggcggactcgccgtgatctacctgctgctgtccctgctcaaccatcggcggctccggaccaccgggttcgacctgggcatcttcgaacaggcggtgcgttcgtacgccgcgggccggcccggcctcgtaccgctcaaggggcccggtttcccgcagctcggtgaccatttctcgcccgtgctggccctgctggcaccgctctaccggatctttcccacaccggtgacgctgctcgtggcccaggcgctgctgctggcggtcgccgtcgtaccgatcatgtcgctcgcccaccggcggctcggcgcgttcgcggcggtgaccgccggggcgggctacggactgtcctgggggatcgcgtcggccgtcggcttcgacttccacgaggtgtgcttcgcggtgccgctgctgtcgttcagcctcgccgcgctcgccgaccggcggctgcgggcggccagcgggtgggcgctgcccctgctgctggtcaaggaggacctgggcctgaccgtggcggtgatcggcctgctcgtcgcggccttcggggcccgccgcctgggtggcgggctcgccgccgccgggctgctcggcaccgcactggcgatgggggtcgtcgtccccgccctgaacccggacgacgcctacgcctattcggcggcggtgggttccgggctgcagcatccggtgacggcggtcaagctgctgaccgtgctcgccctgctggcgccgaccgccggcgtcgcgctgcgatcaccgctggcctgggtcgcggtaccgacgctgctctggcgcttcgcctccggcaacccgaactactggggcaccggcttccactacagcgccgtcctgatgccggtcatgatgctggcgttcgtcgacggcctgacgcgccggcggcccgccgcggaccgcaccggtgccgcggcgacccggctcgtgctggtggccagcctcgccgtcaccgggttcctgctgccgcggtacccgctggcgcagttggcctcggcgccgatctggcggggcgacccccgcggtaccgccgcgcatcgggtcctcgacctgattccggacggcgcgacggtgtccgccgccaaccggctcgttccgcagctgaccggacggacgacggtcacgctgttcgggctggactatccgggcccggctccccggtacgtcgtggtcgacctggaagtcgacgactggccgctgccgcgcgacatccggctcgccagggtcgaggccctggtggccgccggctaccggacggtcaccagggacagtggattcgtgctgctcgaacgtccctgaccggagatcccggccggtgccgcctcaggcggtgacgcgcgaggtgttcacgcactcggcgacgtcgagcaccagcagcaaccggccctcggtcttgtacgcaccggtgaccagcgcccgggacgggccggtcagcgtcgccggcggctcctcgaacatctgcgcgtccaggtacgcgacctggccgatgcggtccaccagcaggctcaccggctcgccgtcgtgccggacgatcacgttcatcaccaggccggtcatgtcccggcggggcagaccgaactgcacccgcaggtccaccgcggcgatcacctgaccgcgcaggttgaacaggccgccgaccgcggtgggggccatcggcaccggggtgtactcgctgtaggacaacacctcctggacggcgtccacatccacgccgaagaactgaccggcgacctcgaaggtgacgaactgacgactggacaagagcggactcccaggtgaggacatgccacggcggaacaccaggtttatcggtggatccggggccgacccaagaagtccggcgggaccgatccggaaatctcggcggtccgccactttcgacgtttcacccatgggagagaacgggtggagctgggcaccgcggtcatcccgatcggctacgagagcccgttccgcctcgccgaggacctgtcgctggccgacgtgctgtcccgcgggcgcctgcaggccgggttcagcgccgggaccccgccgcacgccgagctcctcgggccgctggtgttcgacggcgactggcgcggcttcgacctgtcgcacgggcggatcgcccgcctggccgacaacctgcgcggggactacctgggcgggccggatacggtgatccggtcgccgggcaacacccagcggccccggctgcagccgcacaatccgggtctgatcgaccggctctggtacggcgtgggcagcgccacgtcggcccgctgggccggggcgaacggcctgaacctgctcagcggcaacatcgtcgccggcgagcggcacgacgacttcgccgccgcccagctgcacctgctcgaggaataccggcgcgacgtcgcgccgggccggccggcccgggtcgcgatcggccgggtgatcgtgccgaccgacagtgccgatcggaccacccgggaccgctatcgggcgtacgcggcgagccgtcacgaccgcaccggcaagccacagggcgagcggcggatcctgttcgcccccgacctcgtcggcccggccgcggagatcgtcgagcggctcaccgccgacccggtgctggcccgggtgtcggagctgaggctggagctgccgtacgaattccgccgcgacgactacgagcagatcctgcacgacacggtacggctgatcgcgcccgccctgggccggcgcggcgccgcaccggccgccgcccgggcctgatcagccgaccacggccggggcactcgcctcgacgaaccggacgacccgggcccggacctcggggttcatgttgatgaacagcaggcgcacgtcgcccggctcgtcgccgccggcccggacctgacaggtgatcccggccagcccgtccggcagcccgatctgcacctcgatcaggacgtcgcgttccaggtcctcgacgagccggatcagcgcctcgtcgccgatctcctccaggtcgacggtcacgtgcgccccaccggccgacaggtcgaccgtccggccggggaacagctgtccggacggcagccgcaccgcggccggcaactgcacccgcacccgctcggtccgccgccgctggatgccgccggccgccccgtccacccgcaggtagacgccggggaggctgccggccggcggggcgatcaccgtgccgtcgatgctgcacccgcgattgttctgggtccacagcagcgtggcgtcgaccccgatcatcgcgaacccggtcagcccgaggcgcagggtgccgtcggcctgccgggtgacccggcaggtgcgcgcctcaccgccaccgagcgacacactgaccagtggcacagcccacggctgcggctgctcccacgtcgcactcatgccgtgcccgtcccttcctggaacccctcacgcgagccgccggggcggctgtccatgccgcatggttatcggcaccgcgcggacgcgctgaagaacgaaccgcagccgctctccccgggaccggccaccccgccgtgggcgaagcctcgtcaccggacgaagtcgatctccgggtaacgcgggtccggggcggcgagcaggcgaccgtcccggcctcgcaggtgccggtcgaagaaggcgcgcagataggtgcgctggatcccgatggatcgtgccgggtcgagggttccgaccaggtccgccagctgttgcggggtgagcccgatctcggtgccggcctggggatagagggcgatgccgtcgttgaacgacccgtggaccgagtcgcgcagtctcagctggcgcttccagccgcggtgggcggcccagaacgtgttccaggtgggatcctcggcgccgggcccgtggtcgctgctgaccagcaggaacggccgggtcgaaccaccggccgcggcggggccgacgaaggtgccgtccaggttgacgccggccttgacgcggcgatcgtcgtgcatcacggcggcggcggtgctgccaccgagggaatgaccgaacatgccgatgcggtgcaggtcgaacgcgccgcgcagaccgtccggcagccgccggcggccgacgtccggatggccaccggcgtcgaggacggccagctggtcgaggacgaaccgggtgtcggcggcacggacggcggcggcctggacgacgacctcgtcggtgagatccggcgggagggcggcgacctcgacccgcccgccggggaactcgacctcggaggcgtcgtgggtgtgatcgatggtcacgacgaggtagccgtgggcggccagttcctcgacgaggacggtaccggtgccgcgatcgccgcccaggcccggtgaatacagcagcaccgggtgaccgccggtcctgcgcaggaccggcgccccggtccggccgtgcgtgcgggtgctcaggatccggtcggcgggcaggccgaaggtctcggcgaaatgcggcaccgcgccgggtgacagccacggctccggcagatggccgcgaaggtcccgggccggataccagatctggatcatgatctcccgggcccggcgaccgggcacccacggatcgatgcggctcgtgtcccgcaggtgcagggcgacggtgccgaccccggcggtgccggtcggcgcgggcaggacgtatcccccggtcgaccgacgacgggcagcggcggggacagcgggtccgatgcccgcggccaggccgatcccggcggcgagggtcgcggtgagcagcgtacggcggcgcagggggcgtaccgcagccgtggtgtcggtgtttgtggtcggttccagcatgcccatcacgctgccggacgcgcgacgcggtgtcggtggggcgggcagccggtccggggtggggttttccgcaccccggaccggcgggtggccccgtcgccacggcgccggacggtgtttaccttgatcacatgacagcggcggaagtggggaactcccggacggtgccggccggcgcggcccgcacctggcgggttgccgtccacacgctcgcgggcctgccgctcggcgtgctcggtctcgcgctgaccggcgtgctgccggttggcgccgtctactgcgcgggctggagcctgctgtacgccggccccggcgactggccggcgactgccgggttcgtgctgctcgccgtggtcgcgccggggctggcaccggaggccgcgcggcgcctgaccggggtgcagcggcggcggttccgggtgctgctcggcgccgacatcccaccgccggtccggccggcccgcgggcggcagatcgcctatcacctgctggcctgcttcaccggcgtggcgttcgccgttctggtgctcgtggcgccctggacggccgcccgggtggcccgcgccgacacggccctggcgcgcgccctgctcggccccggccgccgggcggagctgtcgatgcgggtggagtcgctggcccggagccgggccgacgtcgtcgccgcgaccgacgccgaacgccgcaggatcgaacgcgacctgcacgacggcgcccagcagcggctggtgtcgctcgcgatgaacctgggcatggcccgcgccaccctcgccgggacatccgggccggcgatgcgggcgatcgaggacgcccacgacgaggccgttcaggcgctcgccgagatgcgcgagttcgtccgggggctgcatcccgccgtgctcgacgaccgcgggctggacgcggcgctgtccggcatcgccgcccgggccccgctgccggtccggctgctcgtcgacgtgccggcgcggtgctcgccggtggtcgaggcgatcgcctacttcgtcgtctccgaggcgctcaccaacgtcagcaagcatgccggcgccacccgcgccgaggtgatcgtcgaacgcgccgccgaccggctccgggtcgtcgtcaccgacgacggccggggtggcgcgaccaccggcggcgacggcaccgggctggtcggactggcccggcgtgcggccgccgtcgacgggacgttcgcgctgcacagcccgaccggcgggccgaccacgatcaccgtggagttgccgtgcggatcgtgatcgccgaggattcggtgctgctgcgggccggtctgaccaaactgctcaccgacggcggtttcgacgtcgtcgaggcggtcgccgacgccgtcgagctgctgcgcgcggtagcggcgcaccggcccgatgtggcgctcgtcgacgtccggatgccaccgtcgcacaccgacgagggcatccgggccgccctggtcatccatcacgagttcccggccgtcgccgtcgtcgtgctgtcccagttcgtcgaggagcggtacgccaccgacctgctgtccgtccggaccagcggcgtcggctatctgctgaaggaccgggtggcacacgtgccggacttcctggccgccatgcgccgggtcgccgccggcggtaccgcgctcgaccccgaggtggtcgcccagctgctcgtgcggcatcgggccgacccgctgcagcggctcaccccccgggagtcggaggtgctgcggctgatggccgagggccggtccaacaacggcatcgccggcgagctgagggtcagtcacagcgcggtggagaagtacatcggcagcatcttcaccaagctggatcttccgcacaccgactccgaccatcgccgggtcctcgccgtcctccggtatctgcgcccctgaagccgataggagaaatatgacatgcgccacatccggattaagggcgcgcccaccggtcttgagcgtggtgtgactatcgatccggcgccgctgttcaccccgtacaagatcggcgatatcgatcttgccaaccgcttcgtgatggcgccgatgacgcggcagttctcgcccggtggggttcccggcgaggatgtcgcggcctactacgcgcggcgcgccccgcacgtcgggctgatcgtcaccgagggcacctacgtcgaccacccgtcggccgggtccagcgaccgggtcccgcgcttctacggcgcggacgcgctggccggctggcgggccgtcgccgaggccgtccacgcggccggcggcccctagctagctagtggccgcgttcgccaccgcggcccgcgacgcgcagctcgccggcttcgacggcgtggagctgcacggagcacacggctacctgctggaccagttcctctgggcgggcaccaaccaccgcggcgacgggtacggcggcagcctcgccaaccgggcccggctcggcgccgaggtggtcgccgcggtccgggcgaccgtcggaccggacttcccggtgctgttccggttctcgcagtggaagggcacccatttcgacgcgcggatcgccgacacccccggtgagctggagcagatcctcgccccgctggtcgacgccggggtcaccggcctgcacgtctccacccggcggtactggacggcggccttcgagggttcgccgctgaccctcgccggctggaccaggaaggtgaccgggctgccggtcgtggcgatcggctcggtcggggtcgcgcaggccttccgcggcgagaccgaggagccggcaccgaccctcagcgtcgcgccgctgctcgagctcttcgaacgcggcgagttcgacctggtcggcctgggacgcgccctgctctccgagccggcctggccgacgaagctgcgcgcgggccggttggccgacatccgcccgtacgacaaggcggacgaggcccgcctcagctgagccgtccgcgggtcagggctcgtcggcggtgagctgccgctccaaccggccgaggaggtcggtgcaccggcggaccgcgtccaggtcgtcgcccaggtcgccggcgagctcgcgcgcccaggccgcgcgcagcacccgcaggttggccgcggccagctcggtcgggtgcacggcgacgccgcggccggcggtcgcggcacgcgacaccatgcccttgccctccagcccgcgcagcgccgtgctgacgttggtgcgctgcagccgggtgcgccgggcgatctcgctgggcgcggcgcccgggtggaggtcgacgatgcgcatcacctgccgctcggtctcggtcaacggcaccacgtccggactctcgtccggcgtgcgggcgcgcaccaggcggccgacgttgaggatcaggtcggcgagatccgcgagcgcggcgccggcatcgtcacgggtcaccccctgattatggcatcataattatgtgtccataactcaagctccgcccacggcgcggcaccgggcgcggctggccctgatcctgggcgcgttgagcgcgttcggcgcgctcaccatcgacatgtacctgccggccatgcccgggatggccgacgagttggacgccggcgcgaccctggtacagctcaccctgacggtgttcgtcgtcgggctcgccgtcggccaggtgatcgtcggcccgctctcggacgcctggggccggcggcggccgctgctcgccgggatggcgctctacgtgaccggatcgctgtggtgcgcgctctcccccaccgccggctatctgatcggcggccgcgtgctgcagtcgctgggcgcggcggccggcaccgtcctggcccgggccatcgtccgcgacctctaccagggcaccgccatgacccgcttcttcgccaccctgatggtggtcaacggggtcgcaccgatcgtcgcgccggtcatcggcggccagctgctcaccttcaccacctggcgggcggtgttcctggtgctggccgcggtcggcgccatcctcctggtcactgtcgccctcgccctgcccgaatcgctgccccgggaacggcgtgcgccggcacacccgcgggcgaccctgcgggcgttccgcacgctcggcaccgaccggcactatctgcgctacgtcgtcgccgcggcgctgatgttcgcggccgtcttcgcctacatctccggctcgtcgttcgtcctgcaggacgcctacggactcagcgcgcagcagttcagcctggtcttcggcctcaacgggctcggcatcgtggtgttcgggcagatcggcggcatgctcgtcggccgggtcaccggcgagcacaccctgctgcgggtcagcctctcgatcgccgtcctcggctcggccggggtgctggtctgcgccgtcgccggcctgccgctgcccctgctgctggccttcctgttcctgccggtcgccatgctcggcatcgtgctggccaacgccacctcgctggccctggccgggcacgggtcggccgccggggccgcctcgtccctgcagggcctgctgcagttcctggtgggcagcctcgccgcctcggcgatgacgctggccggtccggcgaccgccatcacgatgggcgccaccatggtgatctgctcgatcgccgccctcgccaccctgcgctgacgcgactttccctcagtgcaatttccgaatggcttttccctgcgtgcaacttcggcgctgagggtcattccgcgcggcccggcaccgatggtatggccggaagcggaatcatccgagggggacgcgaatgatgatcgcacgaatttttgcgccattgatgctggcagtcaccaaccgccgggtcggcaccaagatactgctggcggtcgccacgatggcgatcgcgacggtggccgtcggcatcgccgcgatctccggcatgcggcagatgcgggccgccgccgactacgtctaccagcagaatctggtgccgatcacccaggtgacggcgatgcagcggtcggccggcgtcaccaaggccagcctgctcaccgcggccttgtcgcggcagggcgtcgaggcccgcttcgaccagggcgaggatgccgctttcgacgccgccttcgcggcttacacctcctccgacatgcgcggccgggaggcggaggtggcgaccgtgagcgatgccgtacacacttatcggaaattgcgcgacgaacaattgttgccggccatccgcaatcatgaccgggccgcattcgtcagcgtctggggcggcgcgatgacaaccacctcggaccggctggacggcagtctgcagaaactcgtcggcatcgagaccggggtggcccgggagaagaacgccgccaccgcggacaccttccggcaggcggtgatcgtcctcggtgtggtcagcgtggtggggatgatcgcggccgggctgttcggggcggcggtcgccgggtcgatctcgcggaggttgaaccggtgcgtgacggtgctgcgcagcatcgcggacggcgacctgaccgcccgcaccgaggtgaccggcagcgacgaggtggccgggctggccgcgaccctggaccggacgaccgccgccaccgcggccatggtcggcgggatggcggacgacgcggccttcttcgggtcggcgtcgcagcagctctccgaggtgtcgacgcacctgtccacggcggcggagcagacctccggccgggcggtcgcggtctccgcggcggccgaggaggtgtgccggcacgtgcagaccgtcgccgcgggcgccgagcagatgggcgcctcgatcgccgagatcgccagcaacgccaccgaggcggcccgggtgtcggcgcgcgccagcagctcggcggagcgcaccaacgacgtgctcgcccagttggaccactcgtcggcggagatcggcgacgtcgtgacgatcatcaacgtgatcgcgcagcagaccaacctgctcgctctcaacgcgaccatcgaggcggcccgggtcggtgaggccggcaaggggttcgcggtggtcgccggcgaggtgaagacactggcccaggagaccgccaaggcgacgcaggacatctccgagcgggtggccgccattcagcgggacgcggccgaggcgctgaccgcggtcgccgagatcgccgaggtgaccgggcagatcaacagctacgcggggacgatcgcggcggcggtcgaggagcagagcgccaccaccgccgagatggcccgcagcgtggcgcacgccgcgaccgggtcgagcgacatcgcggtggcggtggccgaggtggccgaggtggccgccggcaccgcgaccagtgccacccagacccgggcgacggccggcgggctggcggagcgggccggcgtcctgcagcggaccgccaccagctatcgcacggcgtgaccctctggcggtcggtgctcgcagcccgggccggccgctagctagctagcggcggccggcgtgacccccggcggtcagtgctcgcagccgcggtcggccggcggcaggtccgcgtcgttgcccagcgcggccagcaggcggtagatgcaggagatcacctcggcgagccgctcgggtgcggtgtccgggtcccagtgctccatggcgagccgggacacggtgccggcgatcccggccagcaactgcggatacaccgcctccgggggcagcccggtacgggtacaggcccagcggacgacctcggcgtcgaaggtctcgatcgcggtgatccaccgttgccgcagcgccgggttggcccgcaccaggcgcatccgggcggcgagatcctccgggtcggtcatcagaaactgaatgtgcaccgtgcacaggctgttgagcagcggttcgtccgccgggcggccggccagcagagcggcgagcgtgtcgacccgcgacgggcccgggtcgaccagcgccgcctccttggagtcgaagtagttgaagaaggtccgccgcgacaccggcacctcggtggcgatgtcctcgacgcagacctcgtcgaagccgcgttcctcgaacagccggcgcgccgcgtcctgcagcgaccggcgggtctcccgcttgttgtgctcgcgtcgcccggccacccggcggcctagccacgccggctgaccgcgggggtcagcgctgttccgacggcggcgagcagttccacggcggtgaacggcttctgcaggatgccggtcgccgcgctgaggtcgtaccggtggcggagctcctcatcgctgtaaccggacatgaacaccacccggagatcgggatgacgggtacgcagttgatcggcgatcgccggaccggaccggaaccgcagcatgatgtcgctgagcagtaccgcggcgccggccacgtcggcgtccccggcggcgttctcgtcgagcgggacggtctggtacccgttgccgttcaggatgcggaccaccaggtcgcgaacgaactcgtcgtcctcgaccagcaggatccgctcgccgtgcccggtgaccgggcggtgcgcgtccggctccggctcctgcccggtggtgtcgccggccagcggcagcaggatctcgaaggtggtgccgaccccgggcgtggagtccacctggatgctgccgccggcgtcgccgacgatgccgtagacggtggccaggcccaggccggtgccgcggtcggccggcttggtcgtgaagaacggctcgaacagccggtccttgacctccggtgacatgccgcatccggtgtcgctgaccgtcatccgcacccggcggcccggcgcccggccggtctcgatcagcaccaccccgccgtcgggcatcgcgtcccgggcgttgatcaccaggttgagcaggatctggtcgaggcgcccccggttggcgctgaccgggagggcctgcgggtgcggccggcagagcagactgatgttggccccgatggtccgggtgagcagctcgctggacgcgctgaccacctcgttcaggtcgacgatctccaccgtggcggactcctgcttggcgaacagcagcagctgtccggtcagcgcgcgtgcccggtccgcggcgtcgcggatccgggccaggtcccggctgccgtcctcggtgacctcctcggtgaggaagtcggcgtagttcaggatgatggcgagcaggttgttgaagtcgtgcgccaccccgctggccagctgtccgaggctttccagccgggcggcccgcgccgaccgttcgcgggccagccgctcctccgcctcgcgccgcttgacctcggtgatgtcgcgctcggtggaagccgtcgcgaccacctcgccggtctcgtcgcggatcggcgacaccgcgacggagaccagcatctcggcgccgtcggcgcggatccggcgggcctcgtcgaggtggacgcgctcaccggcggccagcgaggccagcgcccgcccgaaggcggcctgccggtcggccggcaggaaccggccgaacccggtcccgacgacctggtcggccgactggcggtagagctgttcggcgccgccgttccagtgggtcaccaccccgtcgagcgaggtcacgatgatcccgtcggcggactgctcgacgacggccgccagcatctgccgctcctgggcggcgacagtggcggcgcgcagcagcagtccgaggtgtcgggcgaccgaccagctgaccacggtcatcaccacgatcagcatcagtcgcaggacctggtcggcggtgccgagcaggccctgccaggtggagaccgtgaacgcggcggccagcgcatagccgcccacaccgaggaccgccaccggccgggcggtggcggcgacgaacgccggcccgaccgccagcatgccgaacatcagcatgcgcggcggcgccacggccgccgccacggcggacagggtcaccgccgcataagccaccggaatgtacgccgcatggatgccgtgaacgacgaccgccgattgccggaaattcatggtccgggcctttccacgaggccggagtactgcggttgctgattaacggcagactaaacctcgctcagcggcaccggtcgggcttcggggaaagccggtgcgcgcaggcgggcgacgatgcgtgagatccgcgaccgggccggcgcgggcccgatggccggagaaacggctcgcgccgcgcggaggcagcctccgcgcggcgcgagctttggtgaggagtcgtcgttacttgacgaaaccgatgttctcgtagatgacgctggcgaagcccttggcgccgaagttggccaggtccttcttggtggcgatcagctccgggcgctggtagagggtcagcgagtgaacctcctgccagatctgggcgtcggcctggttggccagcgtggccgccttggtcttgtccagctcggcggtcgcgttgttgaaggtggtgtccagctcgggcgagccgacccgggcgtagttctgctggatgtccagctcacccttggcgttcttggtcgggttcgcgtagatcgacttggcggagctgaccgggaactgggtgccgatccaggcgaagaccgtcatgtcgaagttgcccggggtgacgtacttgtcgaagaagtcgtcgaccggcaccgcgttgatcttcaccttggcgccgacctgggccagcatgttctgcaccagctgggactcctgctcggaggacttgacgccggtcgggatcacaaagttgatctcgagcttcttgccgtccttctcgcgggtgtcgccgttgagcttccagccggccgcgtccaggcccgccttggccttctccacgtcgtacttgccgatgtcaccggagttgtcctggtaaccggcctggttcgacatgaagatgtggttgttgagcgccttgggatcgatgccgagcgggccggtcagggccttggcgatggcggtccggtcgatcgcctgggcgagcgcctggcgcaccttgacgtcggacagcacggtgctggtgccgttgatcgtcaggtgccggaagttcgggccggccgccttgcggatctccgcggtgctgatcttcagggcgcgctggtaggcgtccacgttggagccgatgtcgacgaagtcgatctcaccgttggccagcgcgtcgacctgcgcgttcggctcgatcgcccggaagacgatcttgtcgagcttggccgggtcgccccaccacttctcgttgcggaccagggtgatggtcttcgcggtggcgtccgcggagtcgaacttgaacgggcccgcggtggtcttcagcggggacttctgccagcccgcgttgaaggtcttcgggtccttgttcgtcgacgccgggtagaacggggtgaacagcgactgccagtcggcgtacttcgtcttgaaggtgacgatcgcctcgtggtcgtccttgcccttggcgacgctctcgatgttctcgtagccgttggaggccgagatgttgtacgccttgtccgccccgctggtggacttccactgccagtagaggtcctcccaggtgatcggggcgccgtcgttccaggtggccttcgggttcagctcgaaggtgacgacctgcttcgggtcggtcttgaggaccggctcggaggcgaggtagttcttgttccagaccggggtggcgtcagcctcgtagttgtacagctgcggcatcatcgccaggttgacgtagctggcgtcgacgtcggtgccgtccagctcgtagtagttgaagttcgccgggaagccgctcagcgcccaggtcagcgtgccgccgtccttgacctggtcgcgcgacttcgggttgatctggttctcgctcgccttcggcggcggggcagcctgattggtggtcgtgccgctcgacccgctgcacgcggcggtcccgatcagggtagccgccacgaccggcgcgaggatcgctcgcgcgctccagggtttcctcaccaattcctccacaactaagcgtctacaaaggacgcaggttctttcatttacaccagccggtgcggactccgccacaccggccgttaaatcgccttgaccggagccgcgtagtgacaggcggactcgtggtccgggaccacggtgtcccggacggtcagcgccggggactcgtcgaggcagcgctgccgctgcgcgtcgtcgagctcgttggcgaacttggggcaccgggtccggaatcggcagccggacggcgggttcgccgggctgggcaggtcgccggtgagcaggatccgccggcggctgcgctccttgaccgggtcgggcagcgggatcgcggagagcagcgcctgggtgtacgggtgctcgggcgcctcgaagacctggttggccgtgccgatctcgacgatccgcccgaggtacatcaccgccacccggtcggcgatgtgccggaccaccgacaggtcgtgcgccacgaacaggtaggagaggcccagctccaccttcagctgctcgagcaggttgatcacgccggcctggatggagacgtcgagcgcggacaccggctcgtcgagcaccagcaccttgggctccagggccagggcccgggcgatgccgatccgctgccgctggccaccggagaacttggccgggtaccggtcggcgtgctcggggcgcagcccgaccaggcgcagcagctcccggacccgcttctcccgctcggcggccggaaccccgtgggtggccatcggctcggccaggatgtcactgaccggcagccgcgggtccagcgaggccagcgggtcctggaagaccacctgaaggtcgcgccggatggcgaaacgctccttgcggctcatcgcggcggtgtccttgccgagcaccgcgatcgtgccggaggtcggcttggccagctccaggatctccatgatggtggtggtcttgccacagccggactcaccgaccaggcccagcgtctccccctcgcggatgtcgaagctgatcccggcgaccgcctgcaggctgccgaccttgcggcgcagcacgccacccttggtgatcgggtactccttgaccagctcgttgacctcgagcaccacggggcgctgctcgcggggcagccgggccgggccggtggcctccggcaccaccgtggtggggaagacgtcgacgttggtcagttccttgcgggcgatctccgggctgcggtggcaggcggccaggtgcccggcgccgtcgatcaccacgccgagcagctccggctcggtctcctcgcagacctggatcttcatggggcagcgcggcgcgaacgggcagccggccggcaggtccaccatcgacggcgggacgccgtcgatcggggtgagccgctgccgctcgcccatgtcgagccgcgggatcgagccgagcaggcccatcgtgtacggcatccggggccgctggtagacggtctccacctggccggtctcgaccacccggccggcgtacatgaccagcatccggtcggcgaacccggcgaccacgccgaggtcgtgggtgatcatgacgatcgccgcgccggtcgcctcccgggcggtctgcagcacctccaggatctgcgcctggatggtcacgtcgagcgccgtggtcggctcgtccgcgatgatcagcgccgggtcgttggcgatcgccatcgcgatcatgacccgctgccgcatgccgccggagaactcgtgcgggaagcccttcgaccgctgccgcgggttcgggatgccgaccaggtcgagcagctcgatcgcccgctcggcggccgcctcgcgcttgatgtcctggtggatccggatcgtctcggcgatctggtcaccgaccgtgtagaccggggtcaacgcggagagcgggtcctggaacaccatcgagagccgccggccgcgaacccgggagagctgcttgtcaccgaggccgagcagctgctggccctcgaaggtggccgagccggtgatcgtcgcggtgtccggcagcaggcccatgacggccagcgacgacaccgacttgccggacccggactcgccgacgatgccgagcacctcaccgggtcgcacgtcgtagctgatcccccggaccgcggtgaccgggcccgccgggctgcggaaggtcaccgacaggtcgtcgacccgcagcagcggctcgacggcaccggctccactgcccccggcgggggagggataccgggtcacgatcgcgtcggtcacttcgcaccttcgatctcggagttcgggtccagcgcgtcgcgcaggccgtcgcccaccaggttgacggcgaggacgagcagcaccagcacgcccgcgacgaagtagaactgccaccagttggtcagcgccgcgccggagccgtcggcgatcagggtgccgagcgagacgtccggcggctgcacgccgaagccgaagaaggagagcccgacctcggccaggatgatgctgctgacgccgacggtcgcgtcgatgatcagcagcgacgccatgttcggcaggatgtgccgcaggatgatcttccagccgggtacgcccatgaagcgggccgcctggacgaactcacgctcgcgcagcgactgggtgatgccgcggaccacccgggcggtgatcatccactggaagccggccagcagcacgatgaacagcagccagctcccgtcccgcagcgcggtcgagaagatcgcgatgatcaggaagctgggcagcaccagcatcaggtcgatgatcacccggatcaccatgtcggtgctgccccggaagtacccggcgaaggcgccggccacggcggccagagcggtcgaggcgcccgccccgagcagaccgatgaccagcgacttctgcaggccgcgcagggtgcgggagaagacgtcgccgccggtctggtaggtgccgaaccagtgctccggggtgggcggcgactggaaggcctcgaagtccagctggtcgtacttccacttgtagaatagcgggccgaggtaggcgatcagcaccatcagcacgaccacgatcagcccgacgacggccagccgctggcgcaggaagcgccgcagcaccaggcggttacgggagacggagcggggcgccggcggagcgccgaccaccacggattcggtgtcggtagtcatctcggtccccctcagctcgcccggacccgcgggtccagcatcgcgtagacgacgtcggagagcaggccggcgatcagaaccagcacggcgacgaagagggtcaccccggccgtcgagttgatgtcgttcttggtgatggagtcgacgaagtactcccccatgccgtgccagccgaagatcttctcggtgaaggtggcaccgacgaagagcagcgcgaactggtaggagaagaaggtcgccatcgggatcagggcggtgcgcaggccgtgccgggtcagcgcggaccagcgccgcagccccttggcctgtgcggtccgcaggaagtcgctgccgagcacgtcgagcatcgagttgcgctggtaccgactgtagaaggcgaagccgttgacgccgatcgcgagcacgatcgtcggcaggaccaggtgcccgaaacggtcactcagaccggcccaggaccaggtgtccaggcccggcgtgatctcaccgacggtgaacacgagcgggttcgactcgtggcccgacgcctggttgaaccagatgccgccgttcttcatcaggacggcgagcaccacggtggggaccgatagtaggacaaaggatatgccggttaatgtctgatcagaccacttatgttgcttgatcgcaccgtacgcgccggcgaccacgccgagcagcgtgcccaggatcgagccgatcagcatcagccgcagactaacccacatccgccggctcatctcggtgttcaccgactcgccgtcgaccgtcttgccgagatcgccgtgcgcgacccccttcgcccaggtggtgaatcgttcgacgagcggcgtcttgtcgttcatgttgagctcgttgagccgctggtcgacgaccgccgccgccggggcgggattacgcccctcatacctgctccgcggatggagctgcgtcgcagcgagaaggtacgcgaccacggtcgcgaccaacgcgagtactacgaggtaacccaccctacgcaggaggaatttgcccattgcgctattgcctccaggccgggactccgatatctgccgggacgttagcagaggcgccgggggccgccaagatcgatgccgaattcgttgcaacagcgatgttcaaccgacgcggggcccatccgggagcgattgtttcacggttgattcgcgggagtaaataggcccctgtgcccaactaagggttcgttaagccgttcccgacatatttatgagcgccggtctccgggccggccgggacccgcgcccgcgcgccgcggctgcagcgccgcttcggcaccgcgccctcgcaggtgcgggccggtcaccgcgttcgccgcgctcctgccgccggccgggatcttcaccgcgcaccgccgggtggtcatcgccgggggagctcgcctccggcgtggtggccgggatcaacgccacccgcccacccgggcggtcatgccggtcgccctcgcggcgtgcggcttcgtccggctcatcggcggcggccccgcccggcacgccccggcaggatggtcgaccacggaacctccacctccggttcacgctcggcgcggtcgccgtcgtggaccggggtgttcgtgccgaccaccgggcagcggccgccggccgccgcggagccgcgacggcggcggcgcagtcgccccgacgaggtcgccgacgaatgcggcggcgttccggacgtcatcgacttcgaaaaggagttcgatcgtcggtaatgcgctaggggtcagcgtccgaccgcaggggttgttgcccgatttcgatccacctagagttgtcctacaagaaagctgaacggccgacatgaatggtcggctcgcttgatcgagaccgctcgggggggggggtgtggcgcgcatgctcgaaatgggtgtgacaacgcattcggacgacattgtcacggcgtacctcgcaccggcggaatccgccgacatggcgcggcgggcccggcgtgagatcaccgggaccggcgcgccgggcgactgtttccggcgcgccggccggcacgccgggatcctgcccgcccggctccgcgaggcgctggcccgactgcgggccggcagcctcgacgcggtggtggcacacgggctgcccgccgacccgaccgacgccgacgcgccgccgctgctcggactgacctggctaggcatgctgaccaggcaactcggccacgagttcgggtatcccgcggagcagaacggcaccctcgtgcaccacgtgcggccgcggcccgaccgcgccgccacccagtcgaacgcctcctccgcggtggatctgcggctgcacaccgagatcgcgttccacgacgtccggcccgacttcgtgctgctgtacggcgtccgcagccccgagccgcgcccggcgacccgcctcgtccgggtcgccgacgccgtccggaactgctccccggaaaccgtgcagcggctgcgccggccacaattccgaatcaacgccccggacagtttctcgcccggtcaggccgtcgcggaaaatgtcgctccgatgggcggtacgctgcgccagccgaccatccgctggcacagttcgataaccggtgtcgacgacgtcgatcaatgcgctattgcggagttccaggccgccgccgaccgcgaggaacacctcgtccggctcgcccccggcagctttctggccttctccaacagccggtgcctgcacggccgggacgccttcgaggcgcactacgacgggcacgaccggtggctgctgcgcacctacgtgcggcacgacctcacccgggggcgcggatgaacaccgcggggatgctcgacctcgacgacttccggcgggcctgccagggcgtgctggacgcggcccggtggtcctacctggccggcggcgccggtcacgacgacgcggtccgggagaatgaggcggcgctgcgccggctgcggctgcggccccgcccactgaacggcgtcgccgacccggacctgaccgtggacgtgctgggcttccccgccgcgatgccggtgctgctcgcgccgaccagcccgctgcgcctgttccatccggacgccgagctcgcggtgtcccgggccgcccggcgggccggggtgctgccgatcgtcagcaacgacagccaccacagcctcaccgagatcgcgaagcaggggccgtgctggttccaactgtactgctacggcagccgggccgacgtggtgcgcacgatccggctggccgagtccgtggacgcccgggcgctggtggtgaccatcgacaacagccacccgtcgcggcgggtcgcgatgctgcggtccggcttcgccaccccgcccgaggtggagttcggcatccaccgggagagcggcttctccgacggcgcggtgccgcccgacacccggctgccccgctggccgttgacctgggagctgctcgacctgatccggtcgcagacccgcctgccggtggtggtcaagggcgtgctgcatccggcggacgcggcgctgctcaccgatcggggggtggccggcctgatcgtctccaaccacggcgggcggcagctcaacgactcgatcgcggcgatcgacgcgctccccggcgtggtggccgcggccgccggccggctgccggtcctgctcgacggcgggatccgcaccggtggcgacgtggtcaaggcgctggcggccggggcggccgcggtgtgcctgggccggccgtacgtctggggcctgaccctggacggcgaggacggcgtgctcgccgtgctggaactgctgcgggcggagttgctcgacgtcgcccggcagacgggactgcgcgcgctgcgcgcggtccccgcggacctggtggcaccgccaccgccatcgttcacggggagaggaggtggaccacatgatccagcgcatcaaggcgcgcttcgcgcgtaaggccctggccggcgcgtacccctggcactgagatgggtgatcggcggccggtgaccccgcggggtcaccggccgccaccgacacgggaggacagatcagtgaccacggcgccgccggtcccggccaacctgtcccgggccggcctgatccaggagtacgaccgggaccggctcggcttcgtgatggacgcggtccgccggttcggcccggtgaccgagctcagccccggcaccgtgctggtcgccgacggcgaggtcgcccacgacgtgctgcgccgcaccaaccgggacttcctgatggaccgcgaccgggcgtggcggcccaccggcagccggcgcggcgaggacgcgttggagagctggatgtcggcacgccgggcgatgctgtccgccctctccggcggtctggtcgccgaacacctgagctggtattcgggcgagctgaccgggctgctcgacgcgtgggcggcgcgcggcggcaccggcgacccgctgaccccgctggtgcggctgagtaccgacgccttcctgcggctgtgcgccggcccgtcgagtcgcggcgccgaccggcgcgagccggccgccgccgtcgccggactgctggactcgctcacgccgatcgtcggctcctcctacgagctgccctggttcctcgaccggctcaccccacgccggcgccgcgccgtccgcgcccagcaccggctcgcggagagcctgggcgcgctcgtcgaccgggccccgtccggcgggctggtcgcggcgctgcgcgacgccggggtgccgcgtgagccgctggtccggatcctgatctcggccaccatcgcggggcggttggtgccggccgccgcgaccgcgtggacgctgcgcgcgctggccgtgcaccagccggacgacgagccggcgcacatcgtcgacgaggtgctgcgcctctggccgcccacctggctgatccaccgcaccacacacggcgaggagatcagcggggactggcggttccccgcgcgtaccgccgtgatgatctgcccctatgccatccaccgcgacgagcgccactttccggacccggcggcgttccggccggcgcgctggcgcgacggccgcctgccggccggcgcctacctgccgttcggcggcggcccccgctggtgcgtcggcacccacctggccaaggcgcagctcgtcgaggcggtccgggtgttccggcggtaccgcctgaccgacacctcggacgccgtcaccctggacacccgctccaccctgtatccgcgcggcctcgccctgggcgtcggccgtcccgcatgacgaggaagggaacaacccgatgagagtccgcgccggacgagtacgcctgcacgtcacgacgatcggtgacgactggcgcgacggcgtccaccggcccacgatcatcgcggtgcacggcggccccggcatcgacggcaccatgctgcgcctgaccatgctgccggccgccgagtacgcccaggtcatcgtccccgacctgcgcggtcacgggcgcagcgaccggggtggcccggccgagtggaccctggacacctgggccgacgacctggccgcgctggtggacacgctgggcctggagaagccgtacctgctcggcacctcgttcggcgggttcgtggtgcagcggttcctgggccggcacccggagctcgcgggcggcgcgatcctgatcggcaccggcgcccggcaggccagccacgacgagatcgtggaacgccaccgggtgctcggcggcgaccgtgcggccgcggtgatgcgccggtcgctgaccgaccactcgcccgaggccgagcgggagtgggccgaggtctgcgggccgctggcgatccggcgggcgcccgacgaggcgtaccagcgggtgctccgggaccggatcaccactccggagatcaacgccgggttcatcgcccagctcgaccggctcgacctgcggcccgatctggccgccgcgaagtgccgggtgatggtcctggtcggcgagcacgatccgctcatcccgtacgcggtcgccgaggagatcgtggacagcctgcccggccgcgccggcgagctgcacgtcgtgcccggcgccagccaccaggccgtctgggacgcgccggcggccacccacgcgctgatccgcaagttcacggaggagtcgtgaccgcgccgttcacgcagcccaccgccgaggagttccgggccgccaccaccgagctgcgcgagctgaacgcgccgtacgcccgggagcggctgatcttccggccgccggtcgagtcgcccggacaggtgcgccggctggaggccgcctgccaaaccgtcttcgaggggctggacgcggtactgcgcgaggtctgcggcggcgacgtgctgcggatggcgcggctgtgccgggccaccgagccggaactgcagttcctcacccaccagacggatcagaactggtcgacggtggcccgcccggacgtgatcagctccggcggccggaccgtcgtcgtcgagatcaacggggactcccccgccgggctgttcggcctgcacgacatcatcgcccgcgcccaggcggcgttccagcggccggcaccgcaggccccggcccgccccgcggtggcgatgcgcggcctgctggacagcctggaacgcagcttcggccggctgaccggcacggtggcgatctgctactggcggcacgagcagcaggccgggccgctggactggcagtacgagctgttcgcccgcgagctgcgccggcacggcgtcgacgcggtgcactgcgcgctcgaggatctgcggatggatgacgccggcgtcgcctaccaggggcgcccggtgcaggtgatctaccgctacttcgaatcgccggaacccaccgaacatgacgagttcaccctgctcaagcagctgttcgcgctggccggcgcgggcctggtcgggctgttcaccgggtatcgcgccgaggtgctggcgtccaaggcggcactcgcggtgctctccgacgagaccgtggtggaccggctcgacgcggacctgcgcgaccggctggccgcgcacgtaccgtggacccgggtgctggaaccgcgccggaccaccgtcgagggcgccgacgtcgacctgctgccctgggtggccgcgaaccgggaacggctgatcgtgaaaccggtgcgcgggcacgccggcaagggcatcacggtgggccgcgaggtgtcggcgcgggcgtgggccgaggcggtcggcgccggggtgcgcggcggggccggcgaccacccgtacatcgtccagcaggtcttcgaaccggaccggctgccggtggcgttcaccgacgcgaccggccgggccacggtcaccgagacaccgtcggtgaacggtgtcttcatcgtggacgggcgggcggtggcggtgctgcgccggtacgcggtgaacgccaccggcaccatcaacatcaacccgttcagcgggtacgccccgtcgccggtctggaccgcgtcatgaggtggcatccggctcccacgctgttcgccgccggcgcctcggccagcctcggcgacggcatccgctacgccgccttcccgctactggccgtgcacgtgaccaccaacccgatcagcgtgggcgcggtctcggccgcgctgtccgccgcgcacctgctgttcggtttccacgtcggtgcggcggtcgaccggttcgaccgggtccggctgctgcgctcgatgcagctcacccggctggccgtcgtgctggtgctgttcggcgcggtgctgaccggcaccgcgtcgctgcccctgctgctggtgaccgcgtttctgctgggcgcggccgagctggcggccgacaccgcggtgcagtcgctgaccccggtggtggtccgcgacgccgggctggaacggctcaacgccgggctcaccgccgcccagtcgatcggcgaggacttcgccggcccggccgcgggcggcctgctgttctcgctcagcccggcggcgccgttcgcggtcttcgccgcggcgatcggcggcagctgggcggtgctgacccggctgcgggtgccgggccgggtggcgccgccgccgggcgaccggccgtcgctgaccgccgaggcccgggagggcttccgctacctggtccaccacccgtcgctgcgcgcccaggcgctctgggcgaccgcgatgaacctcggggtcgcggccgcgaacgcgaccctggtgctgtacgtcgtgcagcggctgcacctgggcgacagcgcgtacggcctgctgctgaccggggccgggatcggcggcgtggccggcgcggtcgcctcgccgtggacgatccgcctgctcggccggctcggcaccatgatcaccgcgagcctggtggccggcgtggtcaccctcggcatcgcgtgcaccacgtcggtcgcggtgatcgtcggctgccagttcctcgccgggttctccggggtgtcgttctcggtggtcggccggtcgctgcggcagagcatcaccccggacgccctgatgggccgggtgaccggcatctaccgtctgatcgggttcggttccctgccgctgggcgcgctggccggtggcgcggtcgcgcactggctgggcctgcgcaccccgttcctgctggccggcgccctgatggtggtcagcacgctgaccctgggcctgctgacccgccgcgcccagccgccggccgcgaccacggcggcgacggccggacggcaggtggccggcgtccccggatgagcccggggcgcacgctcaggactcggccgcgaccgccaggtgctgccacgcctgccaggtctccagccggtcctcgtactcccgggtgacgatgtccagcggcgcgctgccgaagaagacgcgcagcggcggccgcggatcgtccacgacggccagcagggcggcggcgctggcccgcgggtcgcccacccggcgggccgtgggccggcggtcgcgggccgcgcggaccaggtcgtactccggggactcggcgctgtgccgggcggagcggccggcccagtcggtgcggaacccggacggctccaccagggtcacccggatgccctgggcggccacctcctgggcgagcgactgggtgagcccctcgaccgcgaacttggaggcgctgtacgccccgaggccggggaacgcgaccagtccgccgatgctggacacctggatgatgtgcccgccgccgcggacccgcaggatcggcagcgcggcctgggtgacccagagcaggccgagcacgttggtctccagctgggcccggatctcctcctcggcgagctcctcgaccatgccgaagtggccgtaaccggcgttgttgaccaccacgtcgagaccgccgaagtgggcggcggcgcggcgcaccgcctcgaccgccgcggggcggtcggtgacgtcgagccgcagcgggaggaacgtctccgggaactcctcggccaggccggccaggtcgcacggctgccgggcggtgccggccacccggtcgccgcggcgcagggccgcggccgcccactcccggccgaaaccgcgggaagcgccggtgatgaaccagatcatgcggcggcctccgcccactcccggccgaagccacgcgggacgccggtgacgaaccagatcatgcggcggcctccgccgactcccggcggccggccggcgccgtgatccgcaggcgcagcaggtgcccggcgagggcggccaccccggcgacggccaccagcgcggccaccgcgccccagccgaagtgcaggtagatccgggcgccggcccacgagccgcaggtgccgcccaggaagacggcggtcatgtacacactgttgagccggctgcgggcgcccggcaccagggcgaagatccgcgcctggttggccacctggctggtctgcaccgacacgtcgagcagcagcatgccggcggtcagcccgatcaggccgggcacgccgtgccaggtcccggtgagcagcaccgccgcggccagcagcaggccgccgaagcagagcacgctgatcacgtccggcccgcgccggtcgatctgccggccggccaccggcaccgcgaagacgctggccgcgccgaccagggcgaccaggccgacgacgctggtgccgtaaccgaacgccggtccggtgaggtggagcgcgatgctggtccaggccgcggtgaacgcgccgaacagcaggaactggtagaggcaggaccaccgcagggcgggctgggtgcgcagcagccgcagcgaggtggccagcagggcgggataccgctcggtcgacgagggtgcggtcgccggcagcgccaccaccagggcgatcgcgagcagcaccgcgagcgcggcggcgatcaggtacggcgcgcgccaacccagcagctggccgagcgtgccgccgaaggtgcgggccagcagcaccccgccgagcaggccgccctgcaggatgcccacggtgccggcggcgctggtcggcccggccaggtcggcggccatcgggatgaggatctgcggcaccacggtggccgcgccgacgatcgcgcagaacgcgagcagcggcggcaccgaggaggagatcccggccaggaacaggccggccgccacgacgccgaacagggtggcgatcaggcggcggcggggcagccggtcgccgagcgggacgagcaggaagatcccggccgcgtagcccagctgggccatggtcgcgacggtggtcgccgtgctctccgagatgtgcaggtcccgggcgagcagcggggtgatcgcctgcgggaagtagacgttggccacaccgacgccgcaggccagggccatgagcaggatcaaccggcgagacggcgccggggatgacttcaggtccgtcacgacaactcctcgtaagtgggtatggaacctatataaccggttcccggggaacgggtcaaaccggttcctgagatacggtgcaggggtggcagccgaaccgttccgtcaaggcgccgggcgcctgtgcctggacttcacccgcacgctgcgccgtcgcggccatcccgacgccgtcgaggagctgcccaccccggccgcggtcctcgcctgggtgacgcagttcggcccggtgccggccaccgtcgcgagccttccgccggccgacgtgcaacgctttcgggaggcggtgttcaccctggtcaccaagggaccggcggggtgcgcggcgaccgacctggacctggtcaaccggatcgccgcggcaccaccgccgatcccggcggtccagccggccggcacgctggactggaccgccggcgacccggtcgccgccaccctctcgctggtcgcccgggacgccctcgacctggccaccacgccggccgcgagccggatccgggagtgcgccgacccggcctgcagcgcgctgttcgtggacaactcgcggcccggcacccggcgctggtgcgcgatgagcgcatgcggcaaccgggcgaagaagaccgcctaccgcgaccgggccaccgcaggctgaccgaacggcaccggcaaggcgcaagggaccgcctaccgcgaccgggccaccgcgagttgatcgagcggcaccggccgggcgaaagcgcggtcgcagtgcaccagcggggccggctcggccaccgtgaccgccagcacccggccgaccaggatgctgtggtcgccgccctccaggacactgtccagggcacaggcggcccgggccgcggcgccgggcagaccgggcagacccagctcgtacggccgcatgtcgccggccgcgaaccggtcctcgccggagcgggcgaaccgggccgccaccgccgcctgatcggcggccagtacgttgaccaggaagcgctcggcgcgcacgaacgcggcgtgcgtgctggcggacttcgccaggcagagcagcaccagcggcgggctcagcgacagcgagctgaacgcgctggcggtgaaaccccaccgccggccgtccgggtccaccgtggtcgccaccaccaccggcccgggcacccgggccatcagactggtgaagtcggacgtggtcaccgacatcgcggtcacccctctcccgccggatcgtcgagccgggccaggaaggcctgggcccagtcagtcaggtcatgggcgaagacgtgctcgcgcatcgcccgcatccggcgcacgccctcggccggatccagttccagcgcccggcggaacgccgccttcacgtcgtcgccgtggtgcggattgaccggcagcgcctggggcagctcggcggccgcgccggcgaactcgctgagcaccagcacgccgccgccgtcgtgccggctggccacgtactccttggccaccaggttcatgccgtcgcgcagcggcgtcaccgtgagcacgtcggcggccaggtagaaggcggccagttcggcctggtccaccatggtgtgcaggtagtgcaccaccgggcggccgacccggccgtggtcgccgttgaccgcggagaccagccgctccacccggtcgcgcaccgcccgatactggtccacccgttcccgcgccggattggcgatctgcacgaccaccgtgtcggcggccttgatctggccgtcggcgagcatctcgtggatcgcccgcaggcgcacgtcgatgcccttggtgtagtcgagccggtcgacgccgagcaccacccgggccgggtcgccgagctcggcacggatctgcgcggcccggaggcggacctccgggcggcgggccacccggtcccaggccggcgcgtccaccgagatcgggaaggcgtcgacgcgtaccgcccgatcctcgacgaacaacgacccgggaccggcccggcgcgccccggcgaaccgcacggccgcctcggcgaaccccaccgccgcggccgggacctggaaaccgacgaggtccgcggcgagcatcccacgcaggatctcggcccgccacggcacctgctggaacagctccaccggcgggaacggcacgtgcaggaagaaaccgatccgcaggtcgggccggagccggcggagcatctccggcaccagctgcaactggtagtcgtgcacccacacggtggcgcccggcgcgcaggtctccgccgccacccgggcgaaccgctcgttgacccgcacgtgcccggcccaccagcggctgtcgaaggtcggccggaccaccacgtcgtggtacagcggccacaacgtggcgttggcgaacccgtcgtagtggtcccggacgtcctgttcgctcaaccggaccggaaccagggtggtgccgccgtcggtgaacggcgcgacgtcgacgccggcgacgccgggccagccgacccaggcaccgtgccgccggctcaggaacggttcgagggcgctgaccaggccgcccgggctgcgctcccagagcagggcaccgtccgcggccacccgggactggaccggcaggcgattggcgacgaccacgaagcgggcgtcgtacgatcgctgctccatcgactctcctctttcctcgggggcggcgggagccgggccggagcccggcccccggccgctagcggaagtcgacgatggtcttcaggctggtggtgtgccggtagttctccagcacgtcgaccaggccgtcgtagtcgtcgaaccggcagacgtgggagagcagccgccggccgtcgacgatccgggaacgcagcatctgcatcgccgacgtgatcacgttggcggtcttgtgcatcgggaagtgcgtcacgtcgaacggcgcggcgctgatccggatgcccttggcgagcatcagccaggtgtcgaacttctgcatctcctgcgacgccccgtacagcacgtagtggccgcccggcttcagcttgcgcatcgccacccggcgcgggtcgttctcctccggcactccgctgatcgtcggcagcgtgtcgaagacgtagtcgaaggtgctctccggcaccgtgtcgatcagctcgtgcggcagatacgcgtgctgcgagaagtgctcctcggcgtgctggttgcgggccgggttggcgtccatcgagacgatccggttcggcgccagcagccgctggatgacactgcccgcgatgatcccgatcgggccggtgcccaggatcagcacccggtcgccgacctgcggcgggttggtcagcaccgagcgcagcgcgccggtggtcggctcgatgaacgaggcctccaggtcgctgaggtcgtccggcaccttgaccgcggcggcccggtcgtcgtcgaagaagtgccggtcggcccagaacacgtcctcgaggatctggcccgagaagatcggccgcaggctgcggtactcggcgaagccgccgtagtcggtctgcccccagtagacgatgcggtcgccgatccgcacgtcgacaccgccgccgtcgaactcgggtccgatgtcgacgacctcgcccaggtactcgtggccgaggatcaccgggtactcggaggggaacaggtgaccctcgaagaacgagatgtcggtcgagcagatggagacacagcgggtcttgagcagcaggccgtcggccggggtcgccggcaccggcacttcggcgagcaccgtcttgcgcggtgcgagcagctgaactgccttcatgttcggcattgcggggtcctttcgggaagcggaagagatcagcggcggacgcgcagttcgccgccgaccaggtactggccgaccatctcgaagtgctgcggagcgagggtgatgtgcttgaccgccgagtgcacgtcgcggaacgcccgctccagccggctggtctcatagagcgaggtggagccggccaggtcgtacgcgatgtccacggcctgcacggccagttcggcgacggtggccgcggtgagccggacggtggcggtcaggcgttcgccgccgctctcaccggactcggtgacccgctcggcggtgtcccgcagcagcgtccgcgcggtgtgcacgtgcatggtggcccgggccaggcggtcctggaccacgtggctacgggccaggctgcccgagccgccggtctgcaccttgccgcggaccagctcggtcaccgtcgccacggcgtcccgggccaccccggcggcggtcgaggcggaagtgaacgggccgaagtcgtagtagccgatcgggtaggcgcgggagaaccggccggccggcggccgcagcatcgccgcctggtccaccgtgtactcggccggcacgaagacgtcgtcggcctcgaagtcgttgctgccggtgccgcgcagacccagcgtgtgccagttgtccaggagccggaccgcggacaccggcacgaacagcatccgcagctcgggcgcggacccgcgcagcaccggctgtccgtcgcggtgcaccggcgcggcacagaccagccagtcggcgaacgccgagccgctcgcgaagccccaccggccgctgatccggtacccgccggcggtctcctcggcccgccccgccgggttcaccgcgccgaccaccagaccgccgctctgcttgaacagctcccgggcggtctgctcgggcaggtagtcggagatccggccgatcgccccctgcacacccatctgccaggcgaccgaggcgtccagccgggccagcgcctggatcaccagcgatccggtgtgcaggccgacctggccgccgccgaactcggtggagacccacatccgcgggatcccggcgtcgcgcaacgcctcgaagacggcctgcggggtgcggcgctcccggtcggcctcggcgcggtgccgttcgatcagcggcgccagcgccgccacccgggacagccattccgattgttccccggtctcggggggttcccacagcacgacgaatcacctcaccatcgggaaaaggtttggaaagtgataggaaaagcatgcgccgatccgttggggaaagaaacggcgacttcgtcaaatcgttccgggaaaaactgccccggcggcctgcagaacggccgagcagacatcaatcaattgcaaggtgtacgccgcggacaccatcgtcatgtggtgatgccagccggggaacgagcgtccctcgtaatccagcacgccgaaatcccggcgcagttcggccagtgtcccggcggtccggtcggcgtaccggcccagctccagcgtggtgcccggccggtcggcccggttggtcagccagtaccgggtgaaccggcgggattccggcgaccactcgcccagcagccacaggtcggcgccccggccgccacgcagcgccaccgactgcaccgccaccgtccgcggcgtgccgtccgggtccggcacggtgacgctgtgccgggcccgaccggccgccgcggcctgcagcaactcgcctaccgtcggcgaggtcccgtcccccggccggcccgcccggcacgccgggatgcgctggcccggggacaccgcgatgaccagctcccggcgtccggccagcgccaccaccagcggccacacctcgtccagctcgctcaggtcggccaccagcggcagcccggcgcggaaccgggccgatcgccgcacgacgtcgagcacgtgccgccacaccggtcgcgcctcgaccgagtccgggatccgggcccgggcccgccgggcccggtcggcgccccactccgggccgagcaccagctcccagtccaccggcaccagctgccgcccggtggccaggaacaggctcaccaccagctggcagttgaccgtgcggccggccgccacgacgaaccggcgctgcaccccgacgctctgcgagccgcgtttcgggatcgccgacaccgcgacggtgagcgcctgcccgggcgcggcgtcccagagcatctcggcgagccggcgccgcggaccgccccagtcccacgggctgaaattgatgaactggcgcaggccgcgcgcgacgaaagattccgcgccgaccgagcgggctatttcctgaacggttttcttgccgcgtgcggtgagcattccccggagatagattcgcgcccaccggcgctgatcggcccggcccagatcaccgaacatctcgtcgacgaatgcggagacccgggtctcctgcggcgatcgcacactgtcgtccccgtacaccattcgcatccccgtgtcgtttccagcggtgccccgacgagtcaacggccgctgatgatgacctcactcgcgcgttccgcgagcatggtgaccggcgcctgggtgtgcgcccggacgatgctgggcatcgccgcggcgtccaccacgcgcagcccccgcacgcctcgaacgcggaacgacagatcgaccggcgagtcgtcgcccggccccatccggcatgtgctgaccggatggaagatgctcaggccggtggcccggacgtaccgctcgatctgcgcccggtcggtggagagcgcgccgtcggtgagcggctcaccccgccagcggctcagcaccggctgctccaggatccgctgcgcggcgcggaccccggccaccacggtgtccaggtcggcgcggtcactcaggtagcccgggtcgatcagcggggcgtcggacgggtcggccgagcgcagcgtgatcgacccggtgctctccggccgcagcaggatgaccccgagcgcgaagccgtgctcggcgctcgtcttgtgctccccgtacggcagcaccaggaagaccacctcgatgtccggcccgggcaggtccggatcggtgcgcaggaaggtcagcgcctcggagacgatcgagttcagcgggccggtccggtcccgcaggtaggcgcgcatctgttcggggccggccgacaccccgggcgactcgaagccgcggcccgcgaacgcgagcgggacgagcaggtggtcggccaggttgcggccgaccgcgggcgcgtcgaccaccaccgggatgccgtgctcggccaggtgccccgccgggccgaccccggagagcatcagcaggtgcggggtgccgaccgcgccggccgccagcagcacctcgcggttcgcccggacctgccggatctcgccgtcgatctccacctcgacgccggtcgcggtggtcccgtcgaagatcagccggcgcacccgaccaccggtcaccacgcgcacgttgtcccgctcggcgcaccggtccagatagccctcggcggagctgtgccgcagcccgtcgacatggttcgcccgggccagcagcgtcccctcctgctgctcgccggccggggcgtgcccggccagcgcggcggcgctgagaaagtcggcggtcaccgggctcgggtaccggatgccggccagcggcagccgctcggcgaccgcccgctcgaagtacggcagcacgtcggcgtagccccagcccgggtagccctgctcggcccagccgtcgtagtcggcgcggtgcccgatcgtccacagctgcgcgttgatcgaggccgatccgccgagccccttgccgcgcgggtacgggatcacccggccgtccagcccggcctgcggcacggtggtgaaaccccagtccacctcactgccgaaggtccgcgggaacagcatcgggatgcgcagctccgggatcgaacgcggatcggtggcgcccgcctcgaggaccaccacggtgtgctcgccggacgcactgagccgctcggtgaccacgcatccggcggacccggcgcccaccacgacgtaatccgcggccagcgaagtatcaatctcggtcacggtgcaatctcctcggtcggtcgacatgacaacattgttgacccatgtcaatttgttaacgctctacccgatcggactgcttgaatttacccagccggtcgcacgcgccaaagagaaagcttccgacttcgccaattcgcgcactgagcagcggaaacgtgacgatctgaaaattaggcaagtgacgttcattactggctccgtccactcacgacacctctatttcacctccatgcaacaaagaggcgcccgaggtccaagatctatttatcctgggggaaatcagaagtggatcttcagccagccgcggtaccgctcgcccgacgaccggtacggcggcggccgcaactcggccaggatctcccgatcggtggccgggccaccagccagaccagcaccagctgaacgagcccttgcgcccgcgtcgcacttaccgccgcagtgcgccccaccggttccacccacgacgtcgtgcggcggggcggcaccgacccggggacaagggttttccccgttgtccggggtgccggcgacattcatgctcgtcgaatgatgggacgcagattggcgaccgggctgctgctcggcgcaagcctcgccgtgccggccaccccggcgctggcgaccacctcggcactcgcggccgacaccacccggacgccggccaccccggcgtacacggtcgatctgaccagcaacggcaccggcggcacctggaccgggcacgagagtgtgaccttcagcaacgcatcgccgacgccgctgaccgaggtctatctgcgactgtgggacaactaccacggcagctgcccgtcgacgccgatcacggtgagcaacgtgaccggcgggacggcgtcggcgctgaccgtcgggtgcaccgccatgaagatcacgctcccggcgccgctggcccagggggcgagcggcagcatcgggttcgacctgtcgatcgtggtgacctccggggtggaccggttcgggcacgacggcagctactacttcatcggcaacgcgctgccggtgctggcggtgcgcgacgcggccgggtggcatctcgacccgtacaccgacaacggcgaatcgttctatgccctggccagtgactacacggtgaagctcgaccaccccagctcgatcgtggtgccggcgaccgggacgtccaccgacgtcgccggcggcagcgggcggacggtgaccacggcggtcggcaggcaggtgcgcgagttcgcctgggcggccgggccgttcgcgaagacgtccggcacgacggcggccggggtcaaggtcaacgtctaccgggtgggttcgatcggtgcgggcagcgccacctcgatgctgaacaccgcgaccgcggcgctcgacgcgcacgccgcgcggttcggcgcgtacccgtacggggaggccgacgtcgtcctcgacaacgggttctggttcggcgggatggagtatcccggcttcgtgctcgacctggtcagcaccacggcgctcgcgcacgagctggcgcaccagtggttctacggcatcgtcggcgacgacgagtacaccacgccgtggctcgacgagggcttcaccgactacgccaccgacctgtacttcaacaagaccgggtcgggctgcggcatcacctggcagtcgtcggccgagaaggtgacgaactcgatggcgtactgggacgcgcactccagccgatacagcaccgtggtctacgggtacggcaagtgcacgctgcacgacctgcgccggctgatcggcagcacggcgatgaccaacctgctcaggtcgtacgccgcggcgcactggtacgggatctccaccgtggccgacttcaaggcggcggcccaggccgcagccggctccaccgatctgacctcgttctgggcggcacaccgcgtcgaggggtgaccgtggttcaccggcggcacggtggggtacgacagcgtccatgcggattcatgcggccgggacgctgctcgacggggacctcaccgttccgccggacgccgcgggcatggtgctgttcacccagaacggcccgcgggaccgggcggtcgccgcggcgctgcacgaggtgagcctggcgaccctgctgatcgagccgctgaccgcgccggagcggggggacgacacccgccgcttcgacgtcgacctggtcgccgaccgggtgatcggcaccctccgctggctccgcgcccagcccgtcacgacgtacctcccgatcggtcttttcggagcgggcgtcaacgccgccgccgcgctggtcgccgccgccgcccggcccggcgacgtgcagaccgtggtcacccgcggcggccgggtcgacctggccggcggggcactggcccagctgatggcgcccgccctgttcatcgtcggcgaacgcgatcagcggctgcgcctgctcaacgaggaatcccgtcaggccgcccgctcgcacgccgacatgtgcgtgatcccgggcgccgaccggttcttcagcggcacgcaagccctacggcaggtcaccgtgcaggccgcggactggttccggatccacctggcggccccggtgccgcagcggccgccggagatcgacacggcgctgccggtcgagcactcgagcctgatcgacatgttcccggcgccgtccaccacccaggaacgctgccccgacgacgcgtgacctccgccggtaccggggtatggtcggggaccggaccatgacccgcagcgtgaccaccgagaacctgggcgcctggctgctcaagggcaacgccgacacggccgacctggccggccggttcgcccgcgagccccgggtcgagcggtggtgcgtccggcccggataccggctggacctgatgcgggccgggcagccggtgctcttctgggccagcggcagccggcggcgtgacctgccgtatgggatctggggctggggacggctgcgcgggccggcacgccggggcgggccggaggccggctggtgggtgccgctcgacctggtcatcgccgagccggggcggcggctgcgccgggacgagctgcgcggggatccggtgctggccgggctggaggtgctgcggcagccgcagggctccaatccgtcgttcgtgaccggggcggaactggcggcgatccggcgccgatggatcagcgatgatcgataaatgtcatcctttcggtggaaattgaccgggagtgctagcctcgcccgctggcgggccgagcagtgcggtgaacggcactgcggacattcggctcgcgttcggctgatgcggaggtagtgatgtccgacgagcccacggtggcgacacccggcggcgatcgatccgaccagcctgaggaggcgaccgtcgcgttgccgggggcggcggccgaggcctcgttgacgaaagccgataaatccgaaatttcggacggggcggatgaggcgaccgtcgcgttttccggcagcacgccggtggacgacgagaagaccgcggtcctgagcgagcccgccgaggccggcaaggccgccccggtcggcaaggccgccgcagcaggtgcggccgccgcggcgggcaaggcgacggaaaccgcgaaggtcaccgcccctgtcaaggccgtgggaaccgccgggtccgcggacgaggccaccacggtcctttcccccacgggcaccgatgacgaggcgataacggtcatcccggcgtcgagcagggcggacaccgcggaggaggccacgacggtgatgccggcgggcgccgccgcgcagccgccggaggagaacacggtcgccctcccggccgcggaccggatcatcgcgctccccgcgacccggccgacccccctagctagctagacggtcgcgctccccacggccgccgctcccgccgccgaccacaccatcgcgctccccccgagcggccccgcgtcggcgcctgccgccgcaccggcgagaactccgctgctgacccgacgccggctgattgtcggcctcaccggcgccgccggcgccgccctcgccgccaccgccatccacgccgccaccggcgactccaccccggaggccggcaagcccatcccggcccagtcctccgcccgcacccggccccgggagccggagagcgccccggtcaaaccgaccccgctcccggtccagcgcaagccgatctccaccctcgccgagtacgcgaaggcctccggcgcggccccgttccccagcgacgcgatcgcgctgaccatcgacgacggcccgcacccggtctggaccccgaagatcctgaagctgctggaccagtaccaggtcccggcgatgttctgcatgatcggcaaccaggtgctcggccacgaggaggtggcgaagatggtcaccacggccggccaccagctcgccaaccacacctggagccaccccaccaagctgggcgagaagccgagccgggtggcccgcaaagagatcgagcaggcccaactcaagatcaaccggaccaccgggtacaccccgaagctgttccggtcgccgggcggcgactggtccccgcagctgctgcacgacgtggcgatggccggcctgctaccgctggactggagcgtcgacccgcgggactggacgatgccgggggtcccgaccatcgagaagaagctgctggccgcccacccgggtcagattctgctctgccacgacggtggaggcgaccgctcgcagaccttccagtcgctgagcgtggtgatcccggcgctcaaggcccgtggcctgaagttcgtcgccctctgagcagtgccccgttcgtggcggtctgtcctcgcgaccgccacgccgggctgtccggcaccggatcgccgatcccgcgataggcgccactccgcgtgactaccctcacttaacgcccgccggtggcgagccgatgagaaaaggggtgagacgtccgcggaggtgagggtccggatgcttccggaacaggtcggtgactgggtgctgcacgaactgccccggctgaacgaagcgatcctgaaccaacacgcgccgcccgagctcctggtcaccgagttgtgcgagcacgtgctgcccggcctgccggacccgacccagctgaccccggtgcaggcgcagcggctcgtggtgcatctgggcttcgccggggcgtcggtggcccgccactaccaggagcacactccgggcggcaccgaacatccggaacgggccttcgacgtgttgacggcgggtgaggagcggatcccttttcgccgctacttcgccgggctcgcccagcacaccggcaccggccactacgaccgggacagctacgcgtcgctggtccggtggaacgtcggcacggtccgggtgcggctgcacggcgaggtggtcgccgaactgcccggtgtcttcgacgacgggcggatccgcagctacaccggcacggccggggaggaacgcttcttcctgctggtcaagcagggcgaggcgatcgagctggcggtcaactgcgcgctggagccgctcaccgccgagcacgccagcctgatctgtgagaaggcccggcaccgggtccgggaggccaccgtgctgctggccgagctgcgccggctgttccgtgacttcgcgtcccggccggccgaggagacgatggcggccgacgcgttcatggacgtgttccggcagttcgccgcgcactggacgccgggcgacatcccgccgagcggcgcgctcgacccggaggcgctcaaacgcgacttcctgctcggcatcgacgaaccggagtacgaccggcaggcccgtcgcctcttcccggcgctgctcgaccaggaacgtacggaaatcgggaatctgatgtcggactgcccgctgccgtgccgggtgctcgccgaggtgggcgtggacgaagccgatctgcgcctgtccgacgagggtgacctgcgccggctggtggcccaccacccggcgctgatcgactggcaccggctgctcaccatgcacgcccaggtctccggcgcgcacctgatgctgagcaagaagttcctgttcaagccacagcggcagcgggacgccgcgggcctgggcgaccagcacctggtgtcgaaccgggccggcaccaccgggatgaccgaaacctacctggagcgcctgacccgggcccggcagcggcacaccctcgccgcgctgcgccccgtgctgattccggaaaaccgggatccgggcgccgatccggcggtacggtccgaccggggagcggccgcgccggtcgtactggagctgaccggatgagcggaacggacgacggggtacgtcagggcacccgcgagctgcccggtcgtgatcagctgatggcgctgatcgaccacacctcgtcggtgatctacatgcgcaacgccgacggccgctacatgctggtcaaccgggagtacgagcggctgttcgggctgcgccgcgaggacatcgtggggctcaccgaccacgacctgttcccgccggcgaccgccgacgcgttccgggacaacgacctgcaggcgctggccggcggcgtgccggtgcagatggaggagcgggtgcccggggacgagggcgaacgcatctatctgacggtcaagtttccgctgatcaacggggacggcacgccgtacgcggtggccgggatctcgaccgacatcaccgagcgcagtcgggccgaggccgcgctgcgcgacagcgaggagcggttccggctgctcgccgagcacgcccaggacatcatcttccgctaccggctggccccggagccggcgatggagtacctgagccgggcggtcgagcagatcaccgggttcaccgccgaggacttctacgccgacccggagctgatcgagaaccggatcgagccggaggaccggccggtgttcgagcggtcctggcggatgccccgctccgggacgaccagtttccggctgcggcgccgcgacggggaggtggtctggatcgagcagcgggccggagccgtcaccgcgccgggcggtgcactggtggcggtcgaggggatcctgcgcgacgtcaccgagcggatggccgccgaacgggaacgcgccgagctggaacgccagctgcgccagtcggagcggctcgactcgctgggccagctggccgggggcatcgcccacgacttcaacaacatcctcgcggtgatctccggctacgccgacatgatgatcgacgagctgggtgacgagcaccccagcaagccggacgcgaacgggatcaagcaggccgcggcccggggcgccgcgctgacccgccagctgctgctgttcagtcggtccgagccgtcccgctccgagctgctcgacctgaacgcggtcgcctccgacatgctgcggctgctcggccggaccctgggcgaggacatcgaactgggcaccgaactggtcgcggacctgccgccggtggtgatggaccgcagcaagctggagcaggtggtgatgaacgcggtgctcaacgcgcgggccgcgatgccggccggcggccggctgacgatcagcaccgggcgtgagcacggcggcgccggcgacgaccaggtgtgcctggcggtgaccgacaccggctgcgggatgacacccgaggtgctggcccgggccttcgagccgttcttcaccaccaagggccggggcagcggcaccgggctggggctggccacggcgtacggggtggtcaccgacgcgggcgggacgatcaccctggagtcggagccgggccgcggcaccacgctgcgggtccggctgccggccggtaccgaggacgccgccggggtgaccccggccgccccggccgcggaggacgcggccggtgacgggcggcggatcctggtggtcgaggacgaggagatggtccgtgacatcgtctgccggctgctggtcaaggccggctaccaggtcttcgcggccccgcatccggccgaggcgctgcgcatgtgccgggacgaggcgctcgccttcgacgtcctgctcagcgacgtgatcatgcccggcatgtcgggcacccagctcgccgccgagctgcgccgggaccggcccgggctgccggtgctgttcatgtcgggctacaccagcggaccggcgcccggcggccaggaactgccgaccgacgcgccgctgatccgcaagccgttcgagcggcagaccctgctcgacgaggtgcaccggctggtcaccgagcgggtctgacccgcgatctagaatcgccgggatggatcgctctctgctggccgacttcctgcgcgcgcggcgggaggcgttttcgtggtggccccggccggcgtcctctcgccggcgtcggtaagcatcccgctggccgatgccgcggccctgccgatcgtcggcctgaccgcctggcaggcgctgttcgaccacgcagagctcaccgccggccagcgggtgctgatcaacggcgcgggcggcgcggtgggcggttacgcggtgcagctggccaagaacgcccatgcgcacgtgatcgccgccggcccggtgcgcggcgcggacgagaccatcgatcacaccgccaccgaggtcccgtcggcggtgcgcgaaccggtcgacgtggtgctgaacctggcgccggtcgaccccgcccggctggccggcctgctcaccgtcatgcgcgactgacccgcccgtcagcgggcatggggcggcgcgcttcccgtcgcggccgtcccgtgtcacgggcgtggggcgacccgcttccagccgcggccgtcccgctgatcgcgcggggtggtcgcggccacacacttcgggcagatgaagccgatgtcgtcccccgccccggtcacgtcgctggcccggtagtcgaaccgctggtgcgggaaccggaccaggcgggtccggctcagcgccagcccgcacagcgtctgattggtgccgggcagccaggcgtgcacctccccggccggcgcccggctcccgtccggcccgttcacctggctggatgcggcggtcgccgcggtgctcactcgtgccatgggtgcggcatacccggttaggctcggccgatgcggatggtcctgatggccgacacccacgtgccgaaacgggcgcgcgacctgccggccgccctgtgggcggcggtcggcgcggccgatgtcgtggtgcacgccggcgactgggtcgacgccggcctgctcgacgcgctggaggcgcgctcggcccgactgctcgcctgtcacggcaacaacgacggcccggcgctgcgggcccggctgcccgaggtggcccgcgccgagctggccggcctgcggctggccgtggtgcacgagaccggaccggccaccggccgggaggtccgctgcgcggcccggttcccggacaccgacgtcctggtcttcggtcactcgcacatcccgtgggacagcaccgcgccgggcgggctgcgcctgctcaacccgggctccccgacggaccgccgccgccagccgcactgcacctacctgaccgcgacggtcaccgccggccggctcaccgaagtgaccctgcaccgcctgccggtcagaccgtcttgaccagcttcgggtcgcgtccggccaggaaggcgccgaactcggcctgctggacctcggtcaatgcccgcttcgggatgaccaggacgatccggttggcggcggccagcgtccagcaggcggccgagatcgccacggtggtgaactcccaccgggtctcgcccgggccactggccatctggtagctgtaccgttcggcgccgagggtgaccgtggtgggcacgcacagccgggcggccatccgctgccgcacctgcttgatgccggcgaccagcagcacgcagaacaggccggcgagcagcgagaccacaccgagcaccacaaacaacgcgcccgatccggtcgtgcccagcgcgatcaggcccagcccggcggccagcagcagcacgacgctgaggaggaactggcgtcgcgtgcgctcgctgttgccccgcagcgcggcatcgacttcggcggcggtcggttcgtaatcgacagtgatctccggatgcgcggttaagatcatctatgacggcggcccgccgggcaagagcctgcccgcaggtcgttcggcggagccgcgcgggatcagccgggtcgggatgatgacggtgcggggtgggccggtgtagccgccgatccggtcgtaggccaggcgggccgcggcccggcccatctccaccgtgtcgtgggcgaccaccgtcaccccgaccacgtcggccagctcgaagtcgtcgaagccgaccagggccggccggaccgggtggtcgcgcagggcgcgcagcgcgccgatggtgacccggttgttggtggtgaacagggcggtcggcgggaacggcagggcgagcagctcggtgaccacccggccggcggtggccgcgtcgtggacgtcggtgcgcacgtacggctcccagtccacgttgccggccgcccgcatcgccgccgtgaagccggtgatccgggcctgctgggaggcggtccgggcgaggtcggcgaccagggcgatccggcggtggccgccggccagcaggtgggcggccgcggtgcgggcgccgccgtcgttgtcgatcaggacgctgtcggcggcccggccggccggcggcgggcgatcgaggaagaccagtgggacgttgtgcgcgtcgatgccgccgccgctggggatcaccagcagcgcccggacccggcgttccaccagggcctggacctggctgctctccaggtcgccgtcctcgtcgttgttgacggtgatcagcagcaggccgtgccggcgcagctcgcgttcggcgccgctggcgaccgcggagtagaacgggttggccaggtcgccgctgatcaggccgaccagcgccgaggtgccaccggtgcgcagctcgcgggccaggccgttgaggcggtagccgagctcgtcggcggcctgccggacccggcgttcggtggcccgcgagacgtagggctcgccgttgagcgcccgggacgcggtcttgaggctcaccccggcccgggcggccacctggttgagggtcggcgggcgcgcgggcgtctcgtcggcgggcatgccccgagtatctcccgcgtccggttccggaaccgacggtggattgacttttatcaatctttactgacaacgttgtcatcctcccatggaacccgcgaagggacagctcaatgctccgtaccctggccgtggcgaccgtcctcgtcgccgccgcgttcgcgacacccgcaagtcccgcccaggccgccgacgccgacctcacctcgtacgtcaacccgctgatcggcaccgacgactccaactcccccaacccggtcggcggcggcgccggcggcagcaccttcccgggcgcgatcgtgccgttcgggatgacccagttcagcccggacaccccgaccgcctcgccgtcgggttaccgggaccgggaccggacgatcgagtcgttcagcctcacccacttcaacggggccggctgcccgaacaacgaggacctgccgatcctgccggtcaccggcgccctcggctcctcgccgggcaacgcctggacgtcgtacgccagcggctacaccaaggccaacgagaccgcttcgcccggttactacaagaacaagctggacaagtacggcgtgaccgccgagctgagcgcgaccacccgcaccggggcactgcgcctgacctatccggcgaccaccacggcccaggtcctgatcaacgacagccgctcggcgaccggcgaccgggccggcaatgtgagcatcagcggcaaccgggtctggggcgagcacaccgcgggtgggttctgcgggggtcgtacgtacaagatctattattcgatcctttttgatcggacaccgaccggcttcggcaccttcagcggcggcaccgtctcggccggctcggccaccgcgagcggcacgcagaccggcgcctacgtcaccttcgacacgtcgtcgaacgccgtggtcaacgcgaccgtcgggatctcgttcgtcagcgtggccaacgcgcagaacaacgcgaccgccgaggccgcctcgttcgacacggtcaaggcggccgcgaacgcggcctggaacagcgcgctgaaccgggtgcaggtgaccgctggcggcgccaccgacctgcagaagttctacaccgcgctgtaccacgtgttcagcaacccgaacgtggccagcgacaccaacgggcagtacatgggcttcgacaacgcggtgcacacctcgtcgttcccgatctaccagaactactcgggctgggacatctaccgctcgtgggccgcgctggtcgcgatggtcgcccccgaggtgatgaccgacatcgtcaagtcgatggtgctcgacggccagcagggcggcctgctgcccaagtggtcgcagcagagcatcgaggacttcgtgatgcccggcgacccgggaccgatcgtcgtggacgaggcgtaccagttcggggtgcgcggcttcgacaccgcggcggcgctgaccctgatgaagaagagcgcgaccggcggctcgacgcagggctacgtgctgcgcggcaacgagggcacgtacgagagccagcactacatcgccggcaacccgtcggagaccctggagtacgcgtcgagcgacttcgcgatcagccggttcgccctcgcgctgggcgacaccgccacctacaacacctacgccacgcactcgcagtactggcggtcgctgttcaacggcgagtcgtcgtacatccacaaccgctccggcgggttcccgtggccgctgaacccggccaccgagtcgccgtacaccgagggcaacgccgcgcagtacacctggatggtgccgcacaacctgggcggcctgatcaccctgatgggcggcaagagcaccgcgatccagcggctcgaccaccacttcacccagctcaacggcggactgtcactgccctacttctacgtcggcaacgagccggagcacggcgtgccgtgggcctaccacttcgccggcaaaccgtccggcgccagtgacgcggtgcggcgggtgatgagcgagtcgttcaccaccggcgccggcggcctgcccggcaacgacgacctgggcgccacctcggcgtggtacgtgtggtcggcgctcggcctgtacccggtcacccccggcgcggacaccctggcggtgcacggcggcatcttcccgagcgtgctgatccggcgctccaccggcgacctgaccatctccggcggcagcgcgaccagtccgtacgtccagtccctgtcggtcaacggaaaggcaacgacacacaactatctgcggtacgccgatctcgcctccggtggcagcgtgacgtactcgatggggtcgtcgccctccgcctggggcaccggcagcggtgacacgccgccgagtttcggtgacggcgccaccccgccgatcgccgaacccgacctgggtgcgaacctcgccgccggcaagccggtgattagcggctcggccgagtgcggcagcagcgagaccgcggccaaggcggtcgacgggctgctccggaacaacagcaagtggtgcaccggcggcacgccgaaaacgctgaccgtcgacctcggctcggcgcagaacgtgtcctcggtggtgctcaagcacgccggcctcggtggcgagacgaccggctggaacaccgccgactacacgatccagaccagcaccgacaacgccacctggaccaccgtggtgaccgtcgccggggcccggaacagccgcagctacctgccgttcccggcgcgtgcggcgcgctacgtccggctggccgtcaccaccccgagcaacaacggcgacgccgccgcccggatctacgaattcgaggtgtacgggcagtcctccgccccggccgacctggcgctgcgccgcgcctcgtcggcggactcgtcgtgcgccgccaccgaaagcccggaccgggcgttcaacggcagctggctcggcggctggtcggacaagtggtgctcgcagagcacctcccggtggctgcagaccgacctgggcggcaccacccacatcggctcggtggtgctccggcacgccggcgccggcggcgagtacccggcctggaacacccgggacttcgacgtactcacctccaccgacggcagcacctggacggtccgtgcctcggtgcgcggcaacaccgccgactccaccacctcgacgatcaacgccgacgcccgctacgtccggctcgacgtcatcaccccgacgcaggacggcagcgccgcggcccgcatctacgagatggacgtccgcggctgatcccaccgggccggcccgcctccgctgcggccaggcgggccggcccgttccgctcagacgatccgccgccgcgccgataagggatcctggaggactcgagttccggtgtgagccggtcagggaggggccatggcggagacatcagccaccacgtcctcgtcgcccggcgggcgcccggcagcgacgatcggccggaaactggccctcatcttcgcgagcatcggcgtgctgttcgggctggtctccgtggtggtctaccgctccgtgaacacgctcacggacaccgcgggcaaggtcgagcacacctatcaggtgctcgaccggatcgacgcgctgcggtccagcctcaaggacgccgagaccgggcagcgcggctatctggtcaccgggcaggacgcctacctcgctccgtaccagcaggcactgaccgacctgggcaccgagcagcagcaactccgcagcctcaccgcggacaatccgaagcaacagaaacggctcgacgatctcgcgccgctggtcgatgcgaagctcgccgagttgcaggagaccatcgggctccgccgggacaagggcttcgaggcggcccgcacggtggtgctcaccgacaagggcaaagccgtcatggaccagatccgggcggtggccgaggcgatgagcaccgaggagagcagcctgctcggcgtgcgcgccgcggcggcggcctcggccaagcgcacgacacaggtgaccatcgtcgcggggctcgtcgcgctgctcgccggaatggccgcggctgccacgctgatcacccggcagaccagccggcgggtgagccggctgcgggccgcaatcaccagcctggcaggtggtgacctcacctcggcgagcgggctgaccaccggggacgagttcgggatgatgggccgcgatcttgatcacgcggtcgactcggtccagacgatgatggccgagctggccgccacggtgaccgagctctccacctcggcgcaccagctggcccagctgggcggtgacctcaacagcggcgctgacgaggcttccggcaaggcgatcgccgcctccgaatcggcctccctgatcaacgccagcgtcgagtcggtcgcggcgggcgccgagcagatgaccgcgtcgatccgggagatcgccggcacctccgcgcaggccgccgcggtcgccaacgagtcgctggagatcgcgagcagcaccagccggcagatcagtgaactggggcagtccagcacggagatcagcgacgtggtgcggctgatcacctcgatcgccgagcagaccaacctgctggcgctgaacgccaccatcgaggcggcccgggccggggatgccgggaagggcttcgcggtggtcgcctcggaggtcaaggacctcgcccaggagaccgcccgggcgaccgaggacatcacccggcggatcgccgccatccagtccagcagcgaggccgccggcgtggcggtacagcggatacagcaggtcatcgggcagatcaacgactacagcaacacgatcgccgcggcggtggagcagcagtcggcgacgaccaacgagatgacccggtccatcaccgaggccgccgagaacagccggctcgtgcgcaccagcttcgccgcggtcgcccaggtgacgtcgaccacggccgacgccgcccaggccagccggcgcgccgctgaccacctctccgcactggccggcaagctcaacagcgtggtcagccggttccgctactgaccacgctgatcccggcaagcacgtcccgttgacatcgatcgatggaagagatggggtgatctcacgaccgtcgatgcccaggaggcttgatgtcatcccgtgcccgttgggcggccaccgccgccgcactactactggggctctccctcgccccgctcccggcccaggcgcgaccggccaccaccgtggccgcgcccgcgatctcgctcgacgccggccagcacgccctgatccgcttccggctcaccggccaggcggccctcgaccgcctggtcgcatccggcgccgacctggccgcccacccccggtccgaccgcggcggcatcctggccgacgtggtggtcgacgccgcgcaactggcgtcgctgacccgcggcggtgcggtgccggtccagctcatccagcaggagacgcaccgcgccgtcgcatcgcgcgggatcgccgtggcggccgccgacacgctgcatttcctgcaggcctactggtggaccaccggcgggaagacgttcctgcagacccaggtggcgaccaccgccaccggcgatccggacgtcgagatcaccgtgacctggacgaccgcggacgggaagaccggcacgtacccgctgatccggttcgaggactccggcgaataccagtaccactacgcgttgccgcagccgctgcccggcagaccggtgaaggtcaccgcgagttccagtctcggcggcgtctcccgcccggccaccccggcgacctggcccggcgccaccccgccgcccgcgccggccgggtatcagaaggacttcgtcgcggcatacatgacgcccaccgacatccgggcgcggatcaagcgactggcccggcagtacccgaagctcgtcgacgtcatcgatctgccgaacaggacccagggatatcgccgtacggcggtggcctacctcggagatcccgccgcggccgccgtggtcgtcgagtcggtgaagttcggtgaccagggcgggaacgggatccaggtgcgcaccgtcgacccgggtgcgccgaaccggccgctcgccgcgtcgtacgccgaccgggtgctcaccgtgcggctggccaccgacgccgccggcaagacgatcagcaccaccgacgacgtggccgcggtcatcagcgcgaagtacccgcagcggttccgggccaccgtcgagaccgggtcggccgggctgccgatgccggtggtcgccccggtccggctcgacgacgggctcaagggcaccgaggtgtcgaagaagccgtggaccgtgcaggccctgcggatcggcaaggtgcgggacggctcgaagatcggggtgctggcgtattcccaggaacacgcccgggagtgggccaccccgctggtcaccctggagttcgccgagcggctgctggccaactacgccaccgacccggccacccgcgacctggtcgacaacgtggacgtgttcatcatcccgacggtcaacccggacggggcgaactactcgttcaacgacttcaacttccagcgcaaaaacctggtcgaccactgcaccggcgccagccgggacccgaagtaccgggactcctggggtgtcgacgtgaaccgcaactacacggtcggctcgttcttcgacgggtacgtcggcggcagcgcgaactgcctgtccggcacctactccggcaccggtgagctgtccgaggcggagagccgcaacgtgatcgcgctggccacggcgcacccgaacatcaggttcgcgatgaacgtgcactcgtacggcggctacttcatgtggccgcccggggcataccgggcggacggccgggtcaccctgccccgcccgtcgatcgacgagtcgaagttcttcctggacagtgcccggcgcatcgtgggcgcgatcgcggcttcgcggggcacggtgacctggccggcctacaccgggccggtcgccgacgtgctgtactccgcggccggcaactcggccgacgagctctactacgagctgggcatcgacgcgtgggacttcgaggtcggcaacgaccgctggaacgacaccacccagcagtgggagggggtcggcttccagccgccgttcgacgaggcgcacgccgaatcccaggagtacgccggcgggctgatcgaactggtccgggtcgcccgcgacagccaggccgccgttcactgatccgtgccggcgcgcagggagtcacccagcgcgctgcggaagtagagcaccacccgcccgtgccgggcgcggtcgaccagccggctctcgtagagaacccgcagatgctgactgaccgcgcccggcgtgacggcgagccggtgcgccagctcggtggtcgaggccggctcgtcgagcatcagcagcaggcgggcccgcggctcgccgagcagccggcgcagcgccgggaacgccggcggcggccgcaggctctcggtcatcgtgcccaggccgcgggcccgatagatgatcaccggccggaggtccgggtcgatcgcggtgatcgcgccccgggcgaaacaggtgggcagcagcaccagcccgcgcccgttcacgtcgacccggtcgcgggcgatctccagtggcccgtcccagcggatcgtcagcacgccgtcctcccagtacaaccggtgcgacaggtcggcgaagagcgcgtcggcgcccccctcggcgagcatccgggcccggtagatcaggtccgcctccagcaccgaccgcgcccgcggccaccatcgcggcgcgaggcagcgatcccagtacccggccagcgcacgggcgatccggtcgagcatcgcctccggatcggcggccagctccgccagcaggggtggcacctcccggtcgtgcggccggaaggtccgctccaggtccggcccgaccagctcgggcggggtggcccggagcagggccagctcgtcggcgagggccgggcgggtggtggccgggcgtggggtgaggaagtccgggacgaaccggttggaggcgaccagcgcgcgcagcagatcccggtcgggcagcgcgtcgaaatccgcgcgcatccgctggaaccagccggtctgctcgacgtaatagccgggatgcgaccacatccgtaggctcagcgccgcctcctgcaacggcgaatacgccagcgaggccgacgccaggtcggccaggccgatccggaaccgcatggttgagcccatcgctaaatcattatccgccgatcccggtcaccggtgggatcggggcatgggttccacagtggccgaaaccgccaccagcctgctcccccgcgatccggtggtccgccgcctcgccgggatggtcctggtcaacacactcggcaacggcatgttcatgaccgccagcgcgctctacttcacccgggtcgccggcctcagcgtcgcgcgggtcggcctgggtctgaccatcgccggcgcgtgcggggtcgcggcgagcctccccgccggccgggccgcggaccgctggggcagccgccgcgtgctgttgctgctctgcctcctgcaggccgtgggcatggcggcgtacaccctggtgcacgggttcatcgtcttcctcgcggtggtctgcgcggagaccgcgctggaccgggcggccggcacggtacgcaacacgctgtacgccgacactctcccgccggagacccgggtgccgggccgcgcctatctgcgcgcggtcaccaacgtggggatcggcgccggcgccgcgctggccgcggtcgccctgcaggccgacacccggggcgcctacctggccctgattctgggcaacgcggccaccttcctggtggtggccgcgatcctgccggccatcccggccaagcgtcggccggttcggggcaccgccgccggtccggccgtcgccagccgccgcaacgcgctcaccgaccggccgtacctgctggtcaccgccctgaacgcgctgctcagcatgcagttcgcggtgctcaccgtcggcatcccgctctgggtggtccgggagaccaccgccccgcacgcggtggtcggcgcgatcctgctgctcaacaccgtgctggtggtgatcttccaggtccgggccacccgcgccgcgcggaacccggcccaggcggcccgggcctgccgccgcgccggctggctgctcgccgtctactgcctgctgatcgcgggcagccacggcttcggcgcggtcccggccaccctgctgctggtgctggcggtcaccatcggcacggccggcgaggtgctctcccaggccggcggctggctgctcagctacgacctggcggcggagcacgcggccggcgcctaccagggcgtcttcaacgccggcagttccgcgggcatcatgctcgcgcccgccctgatcacggtgaccgccatcgaccacgcgccctggggctgggcggtgcccgccgccatcttcgcgatcagcggcgcggccctggtccccgcggtccgctgggcgaccagatccccggcggcctgagtcccccggtccgccgggcgaccggatccccggcggcctgagtccccccggtccgccaggtggacaggtagccggccgcctgcgtcccccggtcagccgggcgacgcggtctccggccgcccggggaaggcggcacgcgggctcgtcacgccggcacccgcccggagaagatgccgcgcagggcccgctcggcggccgggccggcctccagcgcgtccagggcgagcaacgccgccccggtcaccggcggcgagtccagcacggtgacctcggcgaacggcgcctgggcccggacgccggccagcacccggtcgtgcagcaggggatgccgggcctgcaggacgctgccgcccaggaccaccgagtgtggccggggcagcaggccgagacggccggcggcgacccggtgctgggccaggatctcttcggcctggcgcgccaccagcgcggcggccacctcgtcaccggcggccgcgacctggaacaggatcggggccagttccgggatccgggcggccgacaggtggccgcggtgcagggcgatgctgaccgcttcgaccgtgggcaggccgaagtgcccggcgaccgccgcggacagcgcggtcgggtcgccccggccgtcctccccgcgggccgccgcgcgcagggcgtagtcggccaggtcgtggccgccgccccagtccccggagaccgggccgagagcgacgaaccgggcggtccggccgtcggcggcccggccgacgcagttgttgccggcgccgcagaccacggtgaccgcgtccggcagcctggcgccggcccggagcagggcgaagcagtcgttgtcggcccggacccgccgcgcccagccctgcgcggtgaccgcctcgtgcagggcggtcacctcgtcgggcaggtcggcgccggccaggtagacgccgatcgcgtcgatcgcggtgtccgccgccaggccggcctcggcccgggccgcggcgatcagcttgccgagcacctcgatggtgccgtccagcccgatgttgtgcggcgacgaggtgccgccgcgcaccatcgccaggatctcgccgtccgcggtaccgaggaccaggtcggtcttcgagttgccgccgtcggccgccaggaacagcgcggtcatcgggcccacgcgaggtggtcacggccggcggcgatcagcctgtcggtgagggcggtggccctttcgtgctggccgatcagcgggtgggccagcagcgcccggtagacacggtcgcggccaccgcgcagggcggcgtcgagggcgagttcctcgtacgaccaggtgtgcgtgatgaggccggccaggtcgggcggcagagcggtgaccggcagcggatcggggccggtccggccggcgcgggcggagacctcgatgaccgcgtcggcgggcaggaacggcagggtgccgaggttgcggacgttcaccgagtggacggcgtcgtcgtcgaggccgaacagggaggcgagcaggccgacggcggcttcggagtagaaggcgccgccgcgttcggcgagcagggccggcttctcggtcagggtgacatcgcggtacatgtccagcagggtcgcctcgatctccgccacgcgctgcccgcgggtgggcgcccccaacgcctcgcgcacatgcccgtcatggcgatagaagtatgacaaatagtaagacggaacgctgcccagcatggagatgatctccgccggcacatccacctgtcccgcgatgtccgacaggtgccgggagagcagttcgggaagtcgatcaacgccgtcgacgaacgccgcccgctcccacgtcaggtggttcaaccccacatggtccaggaccaccgagcccggcggaacctccagataggaggcgaaccgtcgctggaacccgatcgccacattgcacagtcccaccgcccggtgcccggcatcgagcagcgcccgcgtcacgatccccaccgggttggtgaagtccacgatccacgccccgggcctggcccgcgcccggatccgttcggcgacgtccagaatcaccggcaccgtccgcagcgccttggcgaggccacccgccccggtcgtctcctgtcccacacagccgcattccagcgggaacgactcgtcgctgatccgcgcccgctgcccgccgacccggagttggatgaccgcggcgtcggcatcggtcacccccgcgtccaggtcggtcgtccaggtcaccttccccggatgcccgtactgcgcgaagatgcgcgccgcgaacgccccgacgatgtccaggcgctccgcggacgggtcgatcagaacgagttcggtgaccatggtgccgagccgggcgaacccgtccaccagctccggggtataggtggatccgccacccacgaccgcgattttcaacccttgaatcctgtcagcgtgatgccctgcacgaagctgcgctgggcgaagaagaagatgatgatcagcggcgccatggcgagcacggtggccgcggtgaccaggttccagtcgacgtggtgcacggtccggaacgaggccaggcccagcgagagcgtccacgagttctcgttctcgctggtgtagagcagcggcccgtaatagtcgttccagcagtagaagaactggaacaggccggccgccgcgattcccggccgggccatcggcagcacgacgcgcagcagggtgcgccactcgccgcagccgtcgacccgggccgcgtccagatattcgctcggaatggtgagcaggaactgacgcagcaggaagatgcagaacgcgtcgccgaacagggccgggatgatcagcggggcgagcgagccggtcaggccgtaccgggcccacatcagatacagcgggacggtcaccacctgcgggggcagcatcatcacgcagatcaccgtgaggaacagcgcgttgcggccgcggaacttcaacttcgccagggcgtacgcggcgggcacgctggaggcgagggtgaagacggtggcggacaccgcgtacagcatcgtgttgaacagatagtgcggcagcggggttgcctggaacacccgcacgtagttctccgggtgccaggtgttcggccagtaatcgctggtcagcgcctggtcgctggtcatcagcgagagcagcaccaggtacgcgaccggggtgatgaacatgatgccgagcgcgatcgcgatgctgtgccgggcgatccaggcgagccggatccggcgccgttctgccgcggcccgcacgatcgggcggtccaggacgagactcacgattcctccccggagaacgccttggcgcggcgcagcaggacgacggtgatcgcgagcgcgaccacgaacagggcgatggccagcgcgttggcgtagccgagcgcgctgtagcggaacccgacggtgaacagccacagcggataggtgaaggtggagccctccgggtagccgaaggactgggagattccggcgccgacggtggcctgcccgctggcgatcgagccggccaccgccgcctggtcgaagtactgcagtgtgtagatcacgccggtgaccgccgcgaacagcagcaccgggcggatcgtcggcagggtgatcgaccggaatctgtgccaggcgttcgcgccgtccagcgacgcggcctcgtagaggctctccgggacgccgagcaccgccgccaggaagatgatcagcaggtcgccgcaggcccacaggccgagcaggaccagcgacggcttggcccaggccggcgagttgaaccagagcgggccgtcgatgccgaccatcgacaggacgtggttgaccgggccggtgcccggcttgagcaggtagacgaaggcgatggtggcggccaccggcgggaccaacgacggcaggtagaacagcgtgcggtagaaaccggcgccccgcttgaactgcgcgatcatcatggccatgccgagcgtgaagagcatccgcaccgggacgaagaccgccaccatccacagcgtgttgcgcaccgcctgcagcaggaacggatcgccggccatccgccggtagttgtccagcccgacccactgcggcacggtcagcaggtcgaatttcgtgaacgagaagtagaccgccgagatcagggggtagacgaagaacatcccgatgccgagcagcgcgggcgccagaaacgagagggtgaccgcgccccggcgcaggcgaacgccgagcatcgctcagccgcccaggctcatgacgctgttgatcttctggtccgccgcggccagcccctggtccaggtccccgcccttgccggactggtagctggtcaggaactgcccgaaggtctcctggtaggccggcccggaggcggacggcggggtggtcatcgagttcgggttgcggaagatgtcgatgaacgtcttgaagtccggatcggcgttcaggcccgggtcggcgatcgccttggtggtggtcggcacgttcttgagcagaccggccagcttggtcaccgcggcgtcatcggtggtcagatatttgatgagctcccacgccgcctcggggttcttggcgttcttcgagatgcccatgatgttgccggtcacgtaaccgccgccgtatcgggccgggtcggtggtgggcagcggggccaccccgtacttcagcttggggctctgatccttgaggaaggcgaggcggtattcggcatcgatgttgatcgccacctggcccttctggaaggcgttgtcggcgctgaactcgtcgccgagaccggccttgaacctggtcaggttgtcgtacccgtaccagtcgaccaggctcttctgccagttcagcagggtcttccaattcgggtcggcgccgaccgcgctcttgccgtccggggtcagccatttcgcgccggtggacggggccaggtgggccgcggcgttctcgtaatagtcgtacagcggaagaaagcccaccgtcttgagcgagccgtcggcattgcgcacggtgagtttcttggcgtcctcggtcagctcgtcgagcgtcttcggcggcccggcgatgccggccttcgcgaacaggtccttgttgtagaacatgccgtacgcgtcggccaggaacggcatggcgcaccgcttgccctggaactcggtgtaggaccgggtcgtcgcgttcagctgattgaggtcgattttatcccggttgatgtacgcggtgagatccacccaggcgcccgacgagcagaatttgcccacgatgtcggtcgagtacgacagcccgatgtccggcccgttcccggcgccgatcgcctgggtcaccttcgagtcgtcctgaccggatttgacggtcaccttgatgttcgggtggctcgccgtgaagtcgccgaccacctggtcgatggcctgcgcctcgcgctcggtgaagaagtgccacagctcgaccgtcccggagacctgcgtcccgggatcggcgatcttggtctccttgggcgcgggggtgcagccggtgaccagcaaagccgcactagctagggcaaaaagggcatagggcatccgtttgttcacttttatgctccttggcgaatgttttccgaggggaaggatcaggagtcgcggatggcggtgatcagtgcttcgcggaccgcggccagcccggcgtccagcgcgccgagcagcaccgcgtcgtcgtcgatggcggtcaccgcgaacgagctctccagcggggcggcccgcaggaaggcccggttcacggcggcgagcagggtgtcgcccccggcccgggcgaccggcccggcgagcacgacgaggtaggggtcgaggacggcgaccacggcggccaggccggccacgatccggtcagccagcacctccaggaactcggccggcgcggccgccaccacctcggccggcgtgtccccggccagcccgtgctcgcgggccagctcgaggatcgcgccgccgccgaagaggtcctgcaggtcgagcttgcggtcggcggagtccggggcgtagaccggcatgtacccgatctcaccggcgccaccgcgggtgccgcgcagcaacgttccgttgatgtcgatggccagaccgaggccctcctggccgatccagagcagcgcgaagccctccgcgtcctgcccggtgccgcgccggcgctcggccaccgcggccagattcacgtcgttgtcgacgcccacctcggtgcccagcgccgcggcgatcgccgggaccaggccgggccggccgaaaccggggacgtggaccagccggatggtctcggtgcgcgcgtcgtacgagccggggacgccgagttgcacgtgccgcagccggtcggccgggaccccggccgtcacgagcagctggtcgaccgcgtcggtcagggtggcgaccgggtcggcggcgaggaagtcgacccgggactcgaaccgggcccgcacctcgccggtcaggtcgcagagcgcggcggccagcgagggggtgccgctggcgccgacgtcgcggaccgagacggccaccgcgtacgcggcgtccgggtcggccgcgtagatctcggcgttcggccccggccggccgctgtcgtgcccgacgacggtgaccaggccggcctcggtgagccggcgcagcgcctcggagatggtcggggtggacagcgcggtgagccggcgcaggtcggcccgggtgagcatgcccgggtcgagcaggtgtgccagcgccgcgctctcgttcatggcgcggagcagcttggacgagccggccagacgcgtcaacggagcccccggaagcgataggaaaagtgtttaacagttggctcatagttggccaccgggcgatcggtgtcaagagcgatcttgcgacactcatctattgctaagccaacttaacaatcgtaggctgcgtccccatgccccttcacattcgcagaaggacgatcgcctacgccgcattgtccctgctcatccccggtatcgcagtcacctacggcctcctgccggccgacgccggcacggtcacaccatcgacggtcgtcgccgtcgccagcaaaaatctcgacgatccggcgaagaaggaggtcgccatggagatcgtttcggcggctgagaactcgtcgctcgactggcgcgcccagttcgcctacatcgaggacatcggcgacggccgcggctacaccgccggcatcatcggcttctgttccggtaccggcgacatgctggagctggtcgaggcgtacaccgccaccgaaccgtccaacggcctcgccaagtacctgccggccctgcgcagggtcaacggcaccgactcgcacagcggcctgggctcgaagttcgtcaaggcgtggcgggcggccgcggccgacccggtcttccaggccgcccaggagtccgagcgggaccgggtgtacttcaacccggcggtcgccgacggcaaggccgacggcgtccgcgcgctcggccagttcgcctactacgacgccgccgtcgtgcacggctacgagggtctgcgcgccatccgcaagcgcgccctggccaaggcgaaaccgccggcccagggcggtgacgagcgcaaatggttgaacgcgttcctggacgagcgggtggtcgagatgaagaaggaggaggcgcactcggacaccagccggatcgacaccgcccagcgggtcttcctgaacaagggcaacttcgacctgaacacgccgctggacttcaaggtctacggcgacccctaccacatcggttaggtccggacgggggacccgtgggcgagccccgtcgcggcgaccggaagcgatcagggaagatcgcgggatgctgggcgacgacgacgcactcgacacctcggtcctgaccgagcgccagcgccggatcctcggggtcatccgggattcggcgctgcgccacggctactcgccgtcgacccgggagatcgccgacgcggtcgggctggcctccacctcggcggtcgcccgacacctgcgggccctggaggatctcggcttcctgcggcgcggccgggcgacccgtccgatcgacatccggatgttcctgcgggccggcgacggaccccgccgcgatccgggcaccatcggggtgccggtgctcggggagatcgcggccggcgccccgatcccggcgcaggagaccgccgacgaggtgctgtcgctcccccgggatctggtcggccggggcagcggcctgttcgcgctgcgggtgcgcggcgactcgatgatcgacgcggcgatctgcgacggcgacctcgtcgtggtcaagcagcagccggaggcgtacaacggcgacatcgtggccgcgatgatcgacgacgaggccacggtcaaggtgttccgccgccgcgccgggcacgtcgtgctgcagccgcggaatccggcctacgccgacatcgacggtgaccgggccaccatcctcggcaaggtcgtctcggtgctgcgcagcgtctgatccgactttcggccgaggccgggcgccggggaaccggtccgcagtgcgatgcgccgcccggcctgcgttcgtaggctcgatgccatgacgatcgacaccgggccggcgatccgcaccccggcctcccgagccgccgcgctgccggtcgcactggtggccgggctgctgctcggtgtgctcgacttcctctggatcaaattcgtaccgggcccgttcggcgggctggggaactcggtcgcggtctgggcggtcgccgcgttcctgctcaccttccgccaccggtggaccctgcgggtcagcctgctggccgccggggtgcaactgatcgtcgcggtccccgcttaccacctggccgccgctctgatccagcacgacgacccggcgaacgcctacgacaccaccgccctggcctgggcgggcctgggcgtcgtcgcggcgctcgtgttcggcaccggcggcgcgctggcacgcggggcgaggaccccggacacggtgcggcatctcgcgctcgccctgcccggcgcggtgctgttcgccgaggcgggcctgcagctgcgccggatcggggaaccgtcctactcgacgggcgcgctgaccgcgtacgccgcgattctgctcttcctgggcctgctgacgaccgtgctgatggtgccggcctggcgccgtcgcggcctggttctggccctggccctgccactcaccgcggccggtttcgtcgcgttcgacctgaccggcctccactgacgcgcggtgggccgcttccccctgcggcccaccgcgcccggcgggcctcctcagccggcttccgggtgttcgatcacgttctgcaggtagagcggctcgccgagcttctcgatcaggccgagctgggtctccaggtagtcgacgtggtgctcctcgtcggcgaggatgtcctcgaagatccgggccgaggtgatgtcgccgaccgaccgcatgtagtcgtgcccgcggcgcagccggtcgaccgcctccacctcgatcttcatgtcgcactcgaactgttccctgaccgactcgccgatccggagcgcgaacagcttctggtagttcggcaggccgtcgaggaacaggatccggtcggtgaggacctcggcgtgccgcatctcgtcgatggactcggccctggtgtgcttggccagcacggtgtaaccccagttgtcctgcatcttggcgtgcaggaagtactggttgatcgcggtcagttccgcggtgagctgctcgttgaggaactcgatgacacgggcgtcaccttgcatgcctaaatacccccataacgtgacttttcggggataagagtacttgccgtaatcgctaggcagcggagggtagtcgcgtgtcggcgcagccctcctcctcgatcaggtcggcgatccggtccaggcagctgccgcacccggtgccggcgccacacgcgtcgccgaccgacgcctcggtgcgcgcgccgcagcggatggcggtgcgcacatcgcgttcgcggacgtggtgacagatgcagacgaacatcggcgacgacctttgcaacggttagccttaccttgcttagggtgccctaaaacccctgctcacgcaattgccccgcaggatattgattcatacagattgctaaccgatatcgatacgtttacggtgggagcgctcccaagcggaaggaacgctcatgtcccccgtatcccccggcaccagatggctggccgccgcggccgccggcgccaccgtcgcggccggcgccgtcctgctcaccaccggcaccgccgaggccggcacgatcagcggcccgctctaccgcgacccggacaccgcggtggcccgctgggtcgcggcccacccgaacgactcccgcaccgccgcgatccgcgaccggatcgccagccagccggcctcccgctggttcgccgacttcaacctcggcaccatcggctcggaggtcgccggctacgtgaacgcggcgaacgcggccggacagatcccggagctgaccgtctacggcatccccgaccgggactgcggcggggccagcgccggcggcgcgccggacctcaaccagtaccagaactggatctccgcgatcgccgcccacctgggcaaccggaccgcgatcgtgctactcgaaccggactcgatcgcgctgcagacctgcctgagcgccgaccaggtcaccgcccgcgacgaggccctggccaccgccacccggacgctcaaggcggcgaatccgaacgccaaggtctacctcgacgccggccactccgcctggaacagcgcgggcgagcaggcgaaccggctggccgcggcgggcgtcgcgaacgcggacggcttctacagcaacgtgtccaacttcaacccgacgtcggccgaggtcagcttcggcaaggcggtgatctcggcgctgaacgggcggggcatctccggcaagcaccagatcgtcgacaccagccgcaacgggggcgcctccggggactggtgcggggacgacaacaccgaccgccggatcggcctctaccccaccaccagcaccggggacggcgacgtggacggttacctgtgggtgaagccgccgggcgaggcggacggctgccggtacgcggccggctcgttccagccggacctggcgttcagcctggccaacggcgtcccgaacccgccgtcgcccagctcgccctcgcccggctcaccgtcgcccagctcggcctcgcccggttcctcgccggcaccgaacccgggcggtgccgcctgctcggcgacctaccgggtgaccagctcctggcagggcggctaccaggccgcggtcaccgtcaccgcgggccgggcgatcaccggctggacggtcggctggaccctggccggcggccagacgatcagccaggcctggaacggcacgctgagcgtcagcggctcggcggtcaccgtccgcaacgtgtcctggaacggctcgctggcgtccggcgcgacggcggacttcggactgatcggcaccggcgcggccaccacgccggcgctgacctgcaccgcggcctgaccgatcaggatcgtcatccagggcggggcgcaccgaccgacgaagtcggtcggtgcgccccggatcgtccgctgtggagcttcatgctgttcgatgacgggatgcgggtcgcggttgcttccgcggcctggtcccgatcgagcctgcgccgggttcggcctgaccttcgtcctcggcccggggcggcacccggtcgcccacccggtccgtggcggcgagctgatcaacatcgtggcacgccgccgacgagcgcaccgcacgccggtggaacctgccgcggatggtcgcctggatccacgacgtctacgccgcgatcgacaccggcagcgaggcgtaggacgggatcagcaccctacggcggtacgttcgccgcccgatccgccacggcccgtcgccggccagcagggtgcgcagcaggccggcgatctcggcccgggcgaccggcgcccccaggcacaggtgccggcccgccccgaaccacagctgccgctgctccggcaggtaaccgcggtccaggtcgaagccgccggccgcgttgttcgcggtccaggtcagcatcagcacccgctccccggcccgcagccgccgcccgtccacggtcacgtccgcgctgaccgcgcgcccgatcagcggcgccggtgtggtcacccgcagcccctcacggaccgcgtcgggcagccggtccggctcggcccgcagccggtgctgcgccccggtgtcgtgcagcagcgccacggtccgggccatcgcgctggccgcggtctcggtgccggccaccatcagcagcgtggccagcccctccgcctgccgctggtcgaggccgagctcccggcagcggcccagcacggtctccggcggcgcggtgcgccacgacccggcgacgttggcggtcagccgggccacgatggccctggcccggccgaccgtctccggcgcgaggtgcgtggaggcggtggtgcccagagccagggcggcgagttcctcgccggtcgagaagatctgccggtacgcgtcgtcgtggtccgccgcggggatccgcagcaggtccgcgacgatccggccgaccagcacccgggcgagatcggccacgtcgaccgtgcgcccggcccgcagctgcgcacccgcccgggcgagccgcggcccgatcacccggtcggtcagctgccgggcgctctcgtcggtgaacaggtcccgggtccgggtccgcagccggtggtgcccgggcccgtcgaagatctcgtagacccagtcaccgagcacctgcgcccagagatgcccgaccccgccctcgccgagcagggtgaaatgctccggatcgttgaggatccgccgggcggtcagcgggtcggcggtcacccagccgacccgcggcacccggcgcagccggcgggccagccgacccgcggtcagcaggagcggcagcctggggtgcgcggcggcgagaacacggaactcatgacgcccggcgatgtccatcaccccgccatcctcacccgtcgccgccccgcgcgccctttcccggtgctgataccgtccggccggtgacctcgcccacccccggccgccaggccgccggctgcgcgagcgggctgggctgcggcgtcgtggtgctgatcgtggccgccgcgccgctcgccctggtctggctggtgctgcgctgggccggcgtgcatctgcccagcctcgtcaccgtgctgcacgggccgccggccgggaccggctggctggcgctgagcacgatcgccgcgctcgccgtcctggtggtcggtgccgggctggtcgcctggatgttcctcagcgactcggtgcccgagccgctgccccggcgggtgtacctggtctggctgatcccggccctgccggtgctggacctggtgtcgatcgtcgtggcctggatctgccgggcgctcggtcaccccgacgcggcccgcctgctcggcaccggcccgtggctggccggcgctgccctggccacggtcgccgcggtcgtctacagcggcctggtggccaacgaccgctgaccgggcccggccgtcgcccccgaaccgtatgccgccggcctggccctgagccgccccggcggctcaacggccccggttgcgcggatggttcctggccgcgcgctcgttgccgtggcggtagttgccggtgacccgggccatcagctcctgcgggtcgccggtgtccacgtcggccaggaagcgggccgcgaccgggccgcgcagcacgccggcgggccggccgtggtggagtatctccacgtcgccgttcttacggatgcggtaggtgaatccctcaggtgtgccggacatcgctgcatcctcgtcagggacggcgccggcggccatcgaatttcgcgtcgcccggtgggtcaggaccaccagcagctcgaaccgggcggccgggtcgtccaggtccgggccgagcaggtcgcgcaggcggttcaggcggtagctgaccgtctgcgggtgcacgaacagctcggccgccaccgcgccccgcgatccccagtgccgcagccacgactccagcgtcaccagcagctgctcgcgctgcgccggccgcaggtcgtgcagcgccgccagccgccgggaggacagcgcggcgagcgcgcccggctcgccgcgcagggccagcgccgcgaaatggtcctcgacgaagaccgggccggtaccggtgccgaacagctcggcgacccgctcggcgagccggaccgcctcgggcgcctcgggccacggcagggccctagctagctagccggcctgctcgcgcagctgccgggccagcccgtcggtgcaggcggtggcgagctcgtcgacgaacgcgctggtcgcgtcggacagatcgatgatctcctcgacggccaccggcgcaccggcccgcgcatcgaccagagcctgggaagcggcccgcaggagcagccgggcggccgtgcgcagtccgccgagcagcagctccggcccccggttctcgcgggcttcggcggcgcccagcgcgacgaacacctcccggatccgcggcggcagcgccggatcgtcggtgccggccaggtcgaggaagcggtccagggcgacccggaccgcggtgtgcacgtcccggtcgaatttcgccccggcggtctccgcgacggccgggtcggcggccgcgaccgcctcggcgatcgccggcacgatggccggcagccggggccgcatggcggcggcgaggtcggccggcacccgccgccagggagtcgtcacaccgggattttgtcaccccgtgctaacaaccggccagcagatcgcgcgccggaccacggtgcttcataccctgatcggagtgacgatggtgccggtcacacccgacacaccaggatcggatcccgccgtgaaacaccggatgtcccgccggcacgtggtcgacatgtgccggacgatgctcgaccgcggctacctgaaggcgaccgagggcaacgtctcggtgcgcatcccgggccacgagctctacgccgtcacgccgagcaactacgactacgacaggatgcgcgtcgaggacgtctgcatcgtcgacttccgcggtcggcacgtgccggacgagggcggcgcgggcggcctggtgccgtcgatcgagtgcgggatgcacgccaacatctaccgggagcggccggatgtgaacgcgatcgtgcacacccaccagccgtacgcgtcggcgctggccttcctgcgcaagccgatcccaccgctgaccgacgagcaggtgcgcttcctggggcgcgaggtggcgatcatcgactacgccccgtcgggcaccgggttcctggccaagaacgtccagaagaaggtgaagagcggggacaacgccttcatcatcgcgaaccacggggtggtcgcggtgggcaccgatccgtcgcgcgcggtgttcaacatggcgctgctggagaaggtgtcgatcgcctatctgatggccctggcctcggaggcgggcaaggtctacacgatcccggcgacgatccgcgagatcgcgttcagcaagctgaagagggacgaggcgcggatcgcgtcgcagatcgtcgacgcggtggagccggtccgggttgccgaggacgaggagctgccgtcggtcgccgaggtcgtcaccgcgcagacctccgacgagtcgcacggctacatgatcagtgaatacctcgacgtgccggacaccatgcggcgcctcaaggccctcgtcgaccagccgatccgcgggctgcggcacgacgcgctgctggacacgctcgactacttcgcgaccaggtgcacggccagcagagagatcaccgagcgggccaagaggttcattcccggcggcgtccagcacaacctcgccttcaactacccgttcccgctggccatcgacaaggccgagggcgcgtacctgaccgatcgggacggcaacgtctacatcgacttcctgcaggccggtggtccgacgatcctgggcagcaactatgccccggtgaacgcgaaggtggccgacgtgatccgggagagcgggccggtcaccggcctgttccacgagtacgagctgaagctcgccgagatcatcaaccggtacatgccgcacatcgagatgtaccggtcgctgggctccggcaccgaggccgtgatggccgcggtccgggcggcccgggcgcacaccggcaagaagatggtgatcaaggtcggcggggcgtaccacggctggtccgacacggtcgtctacggcctgcgggtgccgggcagcttccggatgaacgcgaagggcatcccgtggggcgccaccggccgcacccgcgaggcgttcccgcacgacctgggcaccctcaagcgcaagctggtcgagaaccgggcgcgcggcggcaccgccgcggtgatcgtcgagccgttcggcccggagtccggcacccggccggtgccgcacggctacaacgcggcggtccgcaggctgtgcgacgagttcggcgcgatgctgatcttcgacgaggtggtgaccggtttccggaccgggatgggcggggcggccgggtacttcggggtgacccccgacctgaccgtgttcggcaaggccgtctcggggggctacccgatggccggcggcgtcggcggcggcgccgacgtgatgagcgtgttcggctccggcctggacggcaagagcggcgcgcacatccaggtcggcggcaccctgtcggccaacccgctgtcctgcgcggccggctacttcgcgatccaggagatggcccggaccaacgcgccggtgatcgccggccgggccggcgaccggctcacccgtggcctgcagaagctgatcgacaagtacgggctgccgtacgtcgcgtacaaccagggttcgatcgtccacctggagtgcagcggcgtgatgctgctcgacatgcgcaacccgctcaaactgctcaaggagaacaaggcgcgcaagaccctgatggagcagatgggcgcggcctacgcggcgcacggcatcatcaccctggccggctcccggatgtacacctcgatggccgacaccgacgaggtcatcgacgacgccctgtcccggttcgaccaggtgttcgcgctggtcgagggggtctaggtggccgtccctccgcagattctcgccgtcgacctgggcacctccgggatgaaggcggccctggtggccgcggacggcacggtcaccgggtgggccgaacgcccggtgccgctcgtggtgctgcccggcggtggcgccgagcaggatccgatcgcctggtgggacgcgctcgccgaggtcgtcgccgacctcggccgggcattcccggaccacctgcgcgcggtcaccacgatctgctcgtcgacgcagggcgaggggaccatcgcggtcgacgcggccggggcgccgctgacccgatgcatctcctggctcgacatgcgcggggcggcacatctgcggaggcagttcggcgggttcccggcgtacgacggcatctcggtccggaggatcgcccgatggctgcggctcaccggtggcatgccgtcggtgaccggaaaggatccggccgcgcacatgctcttcgtgcgggacgagatgccggcggtctacgcgcggacgcagacctttctgaacgtgctggactggatcaacctgaagctcaccggccgcacggtcgccaccgtcgactcgatcctcacctcgtgggtcaccgacaaccggaaggccgacgccatccggtacgcgccgtcgctggtcgccgccagcgggatcgaccgggacaagttcccgccgatcgtgtcgtgcaccgaggtgatcggcacgctcgcccccagcgctgccgatcacctcggcctgcccgcatccgttcaggtggtggccggagcgatcgacaacaccgcggcggccatcggggccggcacggtgcgcgacaacgagccgcacctgtacctggggacgtcgtcgtggatcgcggcgcacgtgccgaggaagaagaccgacgtcggcagcggcatcgcgtcgatcccgtgcgcgctgccggaccggtacctgatgacggcgctgcaggcgaccgcgggggcgaacctgacctggctgcgggacaagatcgtcgagttcgacgacccgctggtgtcggccggccatgtcagccgcgacgagggcaccatcttcgacgcctttgacaagatcattccaagtgtgccggccggggcggacggggtgctctacatgccctggctctacggcgagcgggcgccggtcgacgacccgcacctgcgggccggattcctcaacatctcgctgcagacgactcggtcggacctgctgcgggcggtgttcgagggggtcgcgctgaacacccggtggatggcgaaggcggtggaccggttcctcgggacaccggtgtccaccatggtgatcaccggcggggccgcgcggtcgagctcgtggtgtcagatcttcgccgacgtgctggggatcgagatccggcgggatgccgatccggtggtggtcaacgcgcgcggggcgggttggatcggtgcggtcggggctggcatgatcaactttgccgacatctcggacttagcgcgcaacgaccagattttcaccccggggccgaatcacgccgcctatgacgacatttataagatctacaccactctgcacaagcggctggcgccgatctaccgcagcctccaccagaaaacctgagatcaccatcaggccggggtacgccctgagcccaccgccgcggccagctccagcgccgcgcgccggacgtccccctgccagcggctgggaaacgcgtcgaccagccgccaccccgcgcggtgcagaaccgcctggcgttccgcgtgcacctcggggccgtccgggtgcacggcacacagcaccccgacgaactgcccgccgccggtcagccccgcgccctcccgcatccctgcatctcgctccgccacggccggcgccgcactcgctcgtgccctcttccccggctcctcgacggccggcaccgcaccctctcgcgccccttcgccccgctcttcgacggccggcaccgcaccgccgatgcagaggtcgacgatccacggcccgacccggtatccggcccggacctcgacgtcgagccggcgcagctcggcggcgagctccccggcccagccgccgggctcgaccggcgccggggcgacggggcgcggctcttcggcgtgttccagatagtcgccgagcagtccggccggccgggtcagcgaggtcagcacgatcagccgccgccgggcccgggtcaccatcacattgaacagctgcgcgtcggtgacgaatcgccgacggctcggcgggtccccgtccagcagggccagcgagacgatcaccacctcggcctcgctgccctggaaggcgtgcacggtgccgacccgcaggcgcagctccccgatccgttcggcgggcagcgcggcgagcagcgccgcttccagcgcctcggcctgcgcccggaacgggctgaccaccccgatcccccgcaccccggccgcggccagtcgctccacctgcttcagcgccgcctccacctccgcctcgttgacccccttgaccagctcagcggcctgcacgtggaccacgtcgaccgcatcggtcgcgtccgccggcggggtgcgggtcatcaccgacacccgatcgccgtagaacctgcgcgccgggaaatcgatcaggtgcggcacactgcgatggtgctcggccagccaggtcgccggcgcgctcgccgccgccaggtcgtaggtgctgacccgtcgcacgtccagccgctcgtccgcgccgtgccggtccagcacctgggtcacatcgacatcactgacgaacgacacgaaccgcaactgccgcggatcacccacgatcagtgcccgccgcgcccgggccagcaccggcgccgcccggatctgatccacatgggacgcctcgtcgatcaccaccaggtcgaacaaccccggctccggcggcagcagatcctccacgtcggcgaccgtcccgatccacagcggcagcgcccccaccagcggcgccgcctccatccgggcgagcaactcccggcgccggttccgaccggcccgcagcgcggtggccagcgccccggccgcccggcgcgcgtccggcgtccagcggaccgaactgcgcgccgcatcccgcatcgccgcgccggccagggtccgcaactccgcctcggcccggtgcagcgccgcccatggcgcaccgaggtcggtcccaccggtggcggcgagctgcgccgccgcccgctgcgcggtcgcgacggtcaaagcctgcaccaggacgctcgccggtacgtcgtcggcagccccggccagccgataagccttccgccgcgcccgcttcgcccgccaccgcccccaccagccaccggattgcccaccatccacgttcccggcgcccgcattcccggcgcccgcattcccggcgcccgcattcccggcgcccgcattcccggcgcccgcattcccggcgcccggtggactcgtccagccgccgcccgcgccggcggcatcgaggaggcgtcggatctcggtgaggtcgacgctgccgtcgaaggcgccgggcgcgatcgcggacagccgcggcagatcggcctgcagatccggaagggacgcggccgccgcctccaccgccagggcgtgacgaatctcggcctgctgacgacgtaccgccgcagcggcggcctggacccgctcccggccggaacggaccagcgacagcgggacgccctgacccgcccccgcggtcagctccgcctccaacgccgcatgaccgctgccgaacagcaccggtggcggccccggataccggctcagtagtcgtgccagcacctccgcggcatgcggcgactgtgttgccaccagcaccgatccaccgcgatccaccacttcgagcgcggctgcgacgaccgtgtggctcttcccgctgcccggcgcgccggagaccaccgtgaccggttctgacctcgcccgcacgacaacctgccgctgcggcccggtcaacggcagcggcgagatgaccgggtcaccgcagcgccccgccggctcgtcgccggtcccggccggtgctgcgcctgcgccgtagatcgcggccagcgccgtcccgcccagctcgcgcccggcccagctgcgcagactgtccgcgagtccgaccccgaacacgtcccggaccacgaacaacgcgggtgcggcgatcaggtgcagtccttcggccgggatccgctgccggtgttccagtacccggtcgacggtgaacccggtggcccccgcgaccgattgcaaccatgaccggctgccggtcgcctccagccacccgggcgtcgccagcccgggcgccgcctccagcgccgcggccagctcccggtcctcgaccagcggcgtgacctccagatccccggccggcaccaccttgtaggcgagcagcgaccggtccagccgcaccggctggctcagcagcggcagccggatcctgcgcaccttcccgtcgacctcggcccgcccggcgaggaacccccacccgcgatgcaggatccgctcgtcccggtgcagcgccgccaaccccgccagccgctccacggtcgtatcccgcggcgccttctccgccgtctccagccagacgaacggctgcgccccgcgcgtgacgtccagcgtccgctccccggcagccggcgcgagctcagccaacacctcaagaacagtccgcggccccatcgcgcccgaccctaccgcccaccagccacccgcccacccgcccggacagtgcgaagcggtcagccccggtaggcgatcgggatggtccagccggtcctacgacatggcggcgcgttccaggcggcgggtgaggacccgttcggtgagggcgaccagcaccttcttgaccgagtcccggcggcgggcgtcgcagtcgacgaggggcaggtcgccggcgaggccgagggcctcgcggatctccgcatggtcgaagtgccgcgacccgtcgaaggtgttgacgccgatgatgaacgggatgtcgtggtcctcgaagtagtcgatggccgggaagcagtcctcgatccgccgggtgtcgaccagcacgatggcgccgagggcgccgtcgaccaggtcgtcccagaggaaggcgaagcggtcctggccgggggtgccgaacaggtagagcagcagcgtctggtcgagggtgatccggccgaagtcgagggcgacggtggtggtggtcttctgggcgaccgccgaggtgtcgtcgacgccgatcgacttctcggtcagttccgcctcggtgaccagcggctcgatttcggagacggcgccgacgaaggtggtcttgccgacgccgaagccgccgctgatgacgattttgacggcgaccgggggtgacgccgtgcgggtctcagagcgcacgaacacggtcccggatcctctcgatcagcgtggtggacagttcgccgggggcctggtcgaccaggacgaacccgtcggtgatcaggtcggcgacgacgacccggacgacgccgagcgggacgccgaccgcggaggccaggtcggcgatggacatcggacgctggcacagttcgacgatccggcgggattcgaagcgcagcggggcggacagggcggccggcgcggcgtacagctgcgtctcgatccgcagtccgtcgtgcatcggctcggtgcggccgccggtgatcatgaacggacggacgatcggcccgtcgtcggggttcatcggggcaggctccgccgggactcggcgatcagcgccggggtgagcaggtcgccgaagcgttcggcgaggcgggagatctcgtagccgaccagtccgaggtcgctgtcgccgccggccaccacgccgaggcagctgccgcccgggatgaccgagatgaccaggaagccgcggcgcatctcgatcatgatcagtttcagcccgtcgaactcgtaccgtcgggacgcggtgcgggccaggctggccatgctggacacgatcgcggcgagttggtcggcctcggcgcggctgagtccgtcggagccggcgatcagcagcccgtcggacgagacggcgaccgcgtcgcgcaccccgtcggtctggtggacgaagttgccgagcatccagttgaactggtgccgatcggcgggcgcttccacgctcatcgatgctcctcggaggtcgtgacgaaggtgccccgctgtatgccgtcgcggagcgcggtcagccggtcgcgtaccgcgtcgggtgagtcaatgaggttcacggtggtgtcgtcgcgcgaggtccgcgcgggcgccggttccgcgcggcgcgcccgggggatccgcttgcgcaacccgttggcggtacggtcgggtccgccgagttccggcggggtctgccgttcggtgaccaccacgtagtcgacttccagcgcccggggccggatccgcaccggctcggtggtgcgcggttgctcccggggcggcgcgggcgccggggagggggcgatcggcaggtcggcggcgagcaggtcggcggggaggctgatccgcgcggtcaccccggtcaccgcggacggggtgagccgcacgtcggcgttcatctcggcggcgagccggccgaccacgtagtggccgaggtacttggccggtccggtcatgaagtcgccctcgccgcgcagccgctggttggcccgggccaggtcctcctcgctcatcccgacgccctggtcgcagacggcgatcaggtagccgtcgccgatccgccgcccgtggatctcgacctcgacgtcgggcggcgagaaggtgagcccattctcgatcagctcggccagcatgtgggccagcccggtggcgacggtgccctgcaccatcgcgtcgtcgagccggcgcagcaccacccgccggtactcctccacctcggagaccgcggcccggatcacgtcggacagcggcagcgggccgggccactgccgcgggctggccgcgccgaccagcaccagcaggctttccgcgttgcgccgcatccgggtggccaggtggtcgagctcgaacaggttggccaggccgcccgggctggactcctcgcgttccagccgggtgatgaagccgagctgccggcgcagcaggttctggttgcgccggcccaggtcggcgagggattcggcagtgccgcgacggatccgggcctgttcggtggcgagcgcgtacgcggtggtccgcacccggtccagcgcgtcggcgacccggcgcacctcggcgctggccccggggatgaccgggatcgggtcgggtggcccggcgtcgtcgccggccgcggcccgccggaccgccaccgggagccgctcgccggccagccggtcggcttcggcggccagcgcggccagtggctcggccagtgaccgggtggccccgatcgccaggtaggccgatccggccaggcagagcagcacgatcgcggagagcaccccgagccgcagggtggcgcgttcgcgcagatcctgggcgcgggccagggtgtggtcgccgatctgcccggcgagcgcggtcatctcgtcgagcatcgtggccaccgaggcccaccaggagccggcgtcggcctgcagccgctgccggtcgccggcgcgcagggcggccgcctcgacggcccgggcctgctgggcggccccgctggacagcagggcggtcttggcggccgcggcctgcgggtcggcgaactcgtcgaactcgccgagtgccaggtcgcggttggcggcgatggccagcagccgggagaattcgccggtctggaagcggccggcggtgatcacgccgtccaggaacacccactcctgggcggtggcctccttgacctcggtgagcatctccagcgactcggcgtcgcggcgcaggtcgaggtcgtcgacgatctccaggtgccgggtgtcgtcgccgaggccctcgatcagtttggtgtaggcgtcgaaggtgtcgtcccgggcgtcctggccggcgtccgcccggtcgcggatccggcccaggtcggtcagggagtcgagggcggcgctggcggtgccgccgagggccgagcgcacggtggcccgctggctgtcgacgcgggcccgggccggggcgatccggtcccggaaggcggtgttgccgccgatcaccgcgacggtcaggccgcgttcgttctgcagttcctggatcagactctgcaggccgaggatcagggtgacccggtgggccgtggcggtcgcgttgcggtagcggccgatctcgttgccgtagatcaccgccagcagggccagcatcgccgcgaggggcagggccagcatgcggaccacccggccccggatggtctgatcgcgttcggtcctgcgcgccatgtcgctgtcccttcgccgcggtggaaccgcggggtgtgaccgcggatgaagctgcgggtgaacgtctgaagccgttccgtgaccgccgccaagaattggcgtagcccgcggaacggtcaacaccccgatcgagggacgcggatgccggggaccgcctgggctcggacgctgtcgcgtgcaatttgcagaatccgccccgatcgggggacccggaccgccgccgttcactctggcgtcatgagacatcgacgatttaacatctatgaacgattttcgcgttcgtgtgcaccctgaagggaccgtccatgcgccgacgctgtctgcagttcaccgccgccctctccgcctccctcctgaccacggcagtgctggtccaggtgagcgcaacgccggccaccgcggcgttcgcgagcaacgactactgcctcggcgagtgctccgacatcctgccgcccgggcagaacggcgacgccgacctcgcgcagatcctcgcccaccaggtgctgggcaccatgccgccgcacgccgacgaccagctggcgccgtacgcgaatctggcctaccactacaccggcctcacgccgcagcagatcaacaccttcttcaacgactcgtcgtacggcgtggccgcggcgaacgtggccagcaccgtcacgccccgctcggacgtcagcatcgtgcgcgacaaggcgctcggcatcccgcacgtcaccgggaccacccgggccggcacgatgttcggtgccgggtacgccggcggccaggaccggctgttcctgatggacctgctgcggcacgtggcgcgcggctcgctcacctcgttcgccggcggcgccgtgggcaaccgggagctggagcagagcgtctggcgcaactccccctacaccgaggccgacctgcaggcgcagatcgacgcgctgcgcgccgccggcacccgcggggcgcagctgtacgacgacgtcgtgcagtacctggccggggtcaacaggtacatcgacgactgcatggcggcccgggactgccccggcgaatacgtgctgaccggccacctggacgcggtgaccaacctgggcgggccggagcacttcacgccgaccgatctgatcgccacggccggcgtgatcggcggcctgttcggcggaggcggcggcaccgagatgcagtccgcactggtccgggtcgcggcccgggcgaagtacggcgcgaccgccggagaccgggtgtggcggcagttccgcgagcagaacgaccccgagacggtgctgaccctgcacaacgggcagagtttcccgtacggcgcgggagatgtgaacgccacgggtgtcgccatgcccgacccgggtcccaccccgcagccgatcgtcttcgaccggaccggttccgcgctcaccggcggcgggaccagcacgatcgccgggtcgctgggctcgctcacgatcggcagcgcgagccggggcatgtcgaacgccgcggtggtctcggcggcgaactcggccaccgggcacccggtcgccgtgttcggcccgcagaccggctatttcgcgccgcagttgctgatgctgcaggagctgcagggtccggggatcagcagccggggcgtggcgttcagcggcctcaacctgtacaccctgctgggtcgcgggccggattacgcatggagtgccacgtcgtcgattcaggacatcaccgacacctacgccgtccgtctgtgcaacctcgacggcagcgtggcgaccacggcctccacgtcctacctctaccacggcacgtgcaccgcgatggagaacctgacccggaccaactcgtggaagcccaccacggccgactcgacggccgccgggtcgtaccggctgaccgtgcagcgcacgaggtacggcctggtcacctggcggggcacggtcggcggggcgccggtggcgttcaccgggctgcgcgccacgtacggccacgaggcggactcggcggtcggcttccagatgttcaacgagccggagcagatgggcaccgcggccgccttcaccacctcggcgtcgcacatcgtgttcgcgttcaactggttctacgtcaactccacgcagaacgcgatgtacacctccggcgcccagcccgtccggccggtcggcgccgatccggaactgcccacctggggcgacgccgccaacgagtggaccggctggaacggcgccaccgcacacccgcaggcggtgaaccaggactacttcgtcagctggaacaacaagcaggccggggacttctcggcggcggacggcaacttcagcttcggcgcggtgcaccgggccgacctgctggacgcgccgctcaaggccggggtggcggccggcgtcagatacgaccgcgcctcgctgctgaaggtggtcgagcaggccgcgctgaccgacctgcgcggcagagaggtgctgccggtcctgctccgggtgatcgacacggcgacggtcaccgacgccgcccaggccgcggcgctcgccaagctgcgcgcctggttggcgaacggcgcggtgcgccgggagacggcggccgggagcaaggcgtacgtcgacgcggacgcgatccggatcttcgacgcctggtggccgaagctggtgcaggccgcgttcaccggcgggctgggcgatccgctgttcggcgcgctggtggacgcgctgcagatcaacgagtcgccgtccggcgggcagaccgggccggtgtccaccctgcccacctcggcgaacgagtcgcaggcccacaagggatcggccttccagtacgggtggtggggctacgtgagcaaggatctgcgcgccgtgctgggtgacccggtgccgggctggtccaccacctactgcggcggcggggcggtcggcgcgtgccgcggcgcgctgctgtccagcctcggcgcggcgctgtccgagcccgccacggtcacctatccgggtgatactcactgctcggccggcgatcagtggtgcgccgacgcgatcctgcagtcaccgctcggcgggatcacccacggcctggtcggctggcagaaccggccgacgtatcagcaggtggtgtcgtttccggcgaggcgcggcgacagcgtggccaacctggcggccggccggcccggcaccgcgtcgagcaaccagtccgggtatccggccggcaacgccgtggacggccggccggacacccgctgggccagttcccgggccgacaaccagtggctgcaggtcgacctgggcgcggccaccccggtcgcccgggcggtgatcagctgggagtcggcgtacgcgaagacgtaccggatcgagacctcgccggacgggaccacctggaccctggtggccgctgttgccgcaggcgacggcggcactgacggggtcgccctgacccccaccaccgcccggtacgtccggctcaccgggctgacccgggcgaccggttacggcttctcggtctacgagatggaggtctattcccgttgatcgcacgggcgggcccgccggggtcggggggcccgcccgactaccccccagtagtacccgtaagtaacccctagacgcagctcaggcagggtggttgcggctcaatgggctttaccacctgtactctctcggcgaaggtttttgccgaggtaagggctcgatcgggtgttcacacgaatcgccatcgtcaaccgtggtgaggccgcgatgcggctcatccacgccgtccgggagctcgccgcggagaccggcgtgccgatcgagaccgtcgcgttgtacaccgacgtcgatcgcaccgccaccttcgtccgcgaggccgacatcgcctacgacctgggtcccgccgcctcccggccgtacctggatctcaagggtctggagcacgcgctgatcgccaccggggcggacgccgcctgggtcggctggggcttcgtcgccgaggacccggcgttcgccgagctgtgcgaccggatcgggatcacgttcatcggtccgagcgcggacgccatgcgcaagctcggcgacaagatcggctcgaagctgatcgccgaggaggtcggcgtgccggtcgcggcctggagccgcggcccggtgcagacgctggaggcggccctggaggcggccgagcggatcggctacccgctgatgctcaaggcgaccgccggcggcggcgggcgcggcatccgcaaggtggcctcggccgaggagctgaccgaggcctacgagcggaccagccaggaggcggcccgcgcgttcggcagcggcatcgtcttcctggagcgcctggtcaccggcgcccggcacgtcgaggtgcaggtcatctccgacgggcagggcaccgcgtgggcgatcggcgtgcgcgactgctcggtgcagcgccgcaaccagaaggtgatcgaggagtccgcctccccggtgatgccgccggagcgggccgccgagctcaaggcgtccgccgagcggctcgcggtcaaggtcggctatcgcggcgcggccaccgtcgagttcctctaccaccccggtgaggacctgctggccttcctcgaggtgaacacccggctccaggtggagcacccgatcaccgagtacgtgaccggcaccgacctggtcaagctgcagatccacgtcgcctccggcaaccggttgaccggtgagcggccggtcgagcgcggccacgcgatcgaggcccggctcaacgccgaggacccggaccgcgacttcgccccctcccccggccggatcgtccgcctggagttcccggccggtccgggcatccgggtcgacaccggggtcagcgagggtgacagcatcccgggcgacttcgactcgatgatcgccaaggtgatcgcgtacggcaaggatcgggacgaggcgctgggccggctgcgccgcgcgatggccgagaccaccgtggtgatcgagggcggcgccaccaacaagagcttcgtgctcgacctgctcgaccagcccgaggtgatcgacggcagcgccgacaccggctggatcgaccgggtccgcggcgagggccggctggtctccgaccggcactccggcatcgcgctggccgccgccgccatcgaggcgtacgaggacgaggagctggtcgagcagcagcggctgctgtccaccgcgttcggcggccggccccaggtgcggcacgagagcggcgcgccgctggacctgaaactgcgcggctccacctaccgggtgcgggtcgcccgggtcggcgcgcaccgcttccgggtcggcatcgaggccggcgctgacgtccggctggccgacgtcaccctggagcgcttcgacgagcacagcggccggatcaccgtgaacggcgtgcggcaccggctgctcaccggcacgcacggcgcgatcaccctggtcgaggtcgacggcgtcacccaccgggtcagccgggacgagggcggcgtgctgcggtccccgatgccggccctggtggtggcgaccccgctggaggccggcgccgaggtcgaggccggcgcgccggtcctggtcctggaggccatgaagatggaggcggtgctgcgcgcgccgttccgggcccgggtcaaggaggtgctggtcgcggtcggcaacaaggtcgacgcgggggccgcgctgctgcgcctggagccgatcgccggcgatgacgccgagcaggcggtcaccgagaccgcggccgacgtcgacctgcccgccctgccggacaccgagccggcccggcagcgggccgcccgcggtcaggaggacctgcgcagcctgctgctcggcttcgacgtcgacccgcacgacgagcgccgggtcctcgacgactacctgtccgcccggcgcgccgccaccgacgaggggcaccggccgctggacgccgagatcgcgctgatcgaggtcttcgccgacctgaccgagctgagccgcaaccggccggccggcgaggacggcggcgacacccacgtgcacagcgcccgcgagttcttccacacctacctgcagagcctggacgtggagcgggccggcctgccgcagtcgttccagaccaagctggccaaggcgctgggccactacggcgtgaccgacctggagcgcaccccggcactggaggccgcggtcttccggatcttcctggcccagcagcgcggttcggcggatgccgccgcgatcgccgccctgctgcgcgcctggctgcaggagccgccgccggacgccaccctgcacgagccggccggcctggccctggagcggctgatctcggccacccaggtgcggttcccggcggtctccgacctggcccgcggcgtggtgttcacctggttcggccagccgctgctgcggcgcaaccgggcccgggtgtacgcggagatccgtaagcacctccggcacctcgacgagttcccgcagtcgccggaccgcgccgaccggatcgccgccatggtgcgcagcaccgagccgctggtccggctcctcggccagcgcctggtgcggcacaacctggacaactcggtgctgctcgaggtgctgacccggcggtactacggcaacaaggacctgaccgggctgcaccaggtgacctccggcggcttctcgttcgtcgtcgcggagaagggcgactcccgcctggtctcggccgcggagagcttcgagaaactgcccggcgccctggccgggctggccctgctcgccaccggtgacggccccgtcgacgcggacgtctacctcgcctgggagggccagccggccgacccggaggagatggcggtcgcgctgcacgaggtgatcagccgagtcgcgctgccggcccagatccgccggctcaccacgaccgtcgccgggcgcagcggcgcggtcatgcaccatcacttcaccttccggccgtccaccaccgggatggaggaggagcggctgatccgtggcctgcacccgtacatcgcgcagcggatgcagctggagcggctgcgcaagttcgacctgacccggctgccgtccgcggacgaggagatctacctcttccagtgcgtcgcccgggagaacccggccgacgaccggctggtcgcgttcgcccagatccgcgacctgaccgagctgcgcgagcaggacggccggctggtcgccctgccgaccaccgaggacaccatcgccacctgcctggacagcatccggcgggcccagtcccggcggtcgtcggacaagcggttcagcaccaaccggatcgtcatctacgtctggcccgagctgagcctgacgtacaacgagatggagatgatcgcccgccgggtgtcgccgaccacggccggcgccggcctggaggagatcctgttcatcgcccggcgccgcgacgaggcgaccggcgagctggtcaaggtcaacgtgcggatcacgttccggccgaccggggggaccgagctgattctcagcgcaccgaccaccgagccggtcgagccgctcgacgggtaccggcagaaggtgctgcgggcgagcagccgcaacaccgtctacccgtacgagctggtcgagttcctcggcacgttcgaggagcatgacctggacgagcagcaccggctcgtaccggtgaaccgcccgaagggcaggaactccgcggccctggtcgccggggtggtccgcaccgtcaccccccggcacccggagggcatcacccgggtggtgctgctcggcgacccgaccaagtcgctgggcgcgctctccgagccggagtgccgccgggtgatcgccgccatcgacctggccgcttccctccaggtgccgctggagtggtacgcgctgtcctccggcgcccggatctcgatgagctccggcaccgagaacatggactgggtggccgaggcgctcaagcggatcgtcgagttcacccaggacggcggtgagatcaacatcgtggtggcgggcatcaacgtgggtgcccagccgtactggaacgccgaggccacgatgctgatgcacaccaagggcatcctggtgatgacgcccgagtcggcgatggtgctgaccggcaagcacgcgctggacttcgccggtggcgtgtccgccgaggacaacttcggcatcggcggctacgaccgggtgatggggccgaacgggcaggcgcagtactgggcgccgaacctgatggccgcgcgggacgtgctgatggcgcactacgaccacacgtacgtcgtgcccggggaggacggtccgcgtccggtcgcgaccggcgacccggccgaccgcgacatctcggacttcccgcacacggccgagggcagcgacttcaccacggtcggcgagatcttctcggccaccgccaacccggaccgcaagaagccgttcgacatccgcacggtgatgcgcgccctggccgaccaggaccatccggtgctggagcggtgggccgggatggccgacgcggacacctcggtggtgcaggacgcgcacctcggcggcatgccggtctgcctgctcggcatcgagtcgcggtcggtgccgcgacgcgggttcccgcccaccgacggcccggacacctacaacgcgggcacgctgttcccgcgctcgtcgaagaagaccgcccgggcgatcaacgcggccagcggcaaccgcccgctggtggtgctggccaacctgtccggcttcgacggctccccggagtcgatgcgcaaactccagctggagtacggcgcggagatcggccgggcgatcgtcaacttccgcggcccgatcgtcttcgtggtgatctcccgctaccacggtggcgcgttcgtggtgttctccaagcggctcaacccgtcgatgacggtgctcgcggtggaggggtcgttcgcctcggtgctgggcggcgcctcggcggccgcggtcgtcttcagcggcgacgtggccacccggaccgcggccgacccgcggatccgcgacctggaggcccgggtcggcgcggccaccggcgccgagcgcagttcgctcgccgccgagctggacgagctgcgggcggcggtgcgcaccgagaagctgggcgaggtggccggcgagttcgaccgggtgcacagcatccagcgggccgtcgaggtcggctcggtcgacgcggtgatcaaggccgccgagatgcgcccgaagatcatcgaggtgctccgcaaccacgcctgacggttactgatcagtggggcccggcatgcgtcgggccccactgccgttactcgtgttgacacacatcagcgggacgcctagctggtgccgcacggtcgatacaaatgatgatggactgatgccgcgccgacgttacgagctgcgcgaccggatcgcgggtctggacccggaacgcgaccacctggagatctaccagctgtccgcggggcgcgaattcccctgggactacacccgggcgctggagttcgcactgttccgcacctactgcgtgccgagcatctcgcggctgctggcggcgaccggcgagttccggctgcggccgcagaaacgctacgacgacaccgcgctgctgatggccgagatcgcggcgcacggttacgactcgccccgcggccgggaggcgctcaaggtgatcaaccgggcgcacggccgtcattcgatcggcaacgacgacatggtgtacgtgttgtccaccttcgtctacgacccgatcgactggctcgaccggttcgggtggcgcccgctgcacgagcacgagcgtctcgccgccttccactactaccgggaggtcggccgccggatggggatccgcgacatccccgccggtttcgcggatttcgccgcgttcaagcgggactacgaggcccggcacttcgtctactcggacaccaaccggcagatcggcgactacacggtcgggttgttcgccgcgtggttcccgcgattgctgcgcccggccgtccggctggcggtgcggggcatgctggacgagcggatgctggccgccttcgggttcaccccggcgccccgctgggtcggcgcggtgggggaagccgggttgcgggcccgggcccgggtcctccggttcttccccccacgtcgtacgtcagtcctgggaatctcacccggcaaccgcacctatcccggctatccgcgcggatatcggcctgccgacctgggcgtcagcccttcttcaggaccggcgagcgctgcagacgggccagcacccgccgcgcggtgagcggcaccaccgagatcatcaggcggccggactcgtcgacggtcggcgcgatcgcgaacagccgcccgccgcgccctagctagctaggccgggtcgaagtcgccgggctgggccgagaccgcccgccgctgcccggagtcgccggagcgggccagcacctcggccacgtccagccggatcgtcacacccttgccggtgcgctccacccgggccgggatctcctcggcactgacgctgcccggcgagccgccgttcgcggtgatcaccagttggtcgccggcccaggtgaacccggtggcgtcgagcttggcgtcccagtcgggcacgtcggtgacgtcgaagacctcgtcgggcagggtgccgaagccggggtacgcggcgtagcgccggccgccgcgctcgaccgtgtccgggacgcccccctcggcgtcctgccggatcaccgcgatcaggtcgtcgaccgtgccgtgccgggcgaccgcgagccggatccgggtctccggcccgagctgggcggcgatccggtcggtgaggtactccccggccagccggccgacggtgcggtgcagctgctcctgggtgggccggtcgagtttcagcacgtcgtcctcgagcagccgggccacctcgtggtcgaagcggtgcaccatgatcgcgtcgcggcgctcgcccggctcgatcaggttcgccacgaacgtcatgatcttctcgacggtctcgatccgcagaccgtgccggctcaggtaggtgatgttggtggcgctgaaccggcggaccgcgaagtagtagtcgtagtcggcgagcaccgagatccgccgcgcgtggaagcacgcggccagcgtgaacggcaggtcgctgccgatcttcatgtcctccgggtaccggatgccgtgctggttcagcagctcccggcggtacagcttggtgttggccagcgaccgcggcagcggcgagtcgaacaggtcgacgtcgggctggctggactggtagatgtcctgatagatgtgccggctgttgaccccgaccacccggcccagcaccacgtcggagccgtactcgtcagcggccttgaccaggcgctccagcgcttccgggccgagccggtcgtcggcgccgacgaagaacacgtaccgcccggtggccgcctcgatgccgcggttgaacggcccggccgggccgcccgagttcgcctggtggatcaccgtgaacaggcccgggtaacggcggtcgaaccggtccagctcggcgccgccccggtcggtggagccgtcgtcgaccgtgacgatctgcatccgcccggtcccgatggtctgccggaccagcgagttcaggcactcggtcaggtacggcatggtgttgtagaccgcgaccaccacggtgacatcgggcgtgctcatccgagtagctcctgatagatggtgttcagccggtcggcctgcgcctcccaggtccagcccggcagcgggctgtccggagcgtcgtacacggcccggtaccgcttcgggtcggcgagcaccgcccggaccgcgcgggccaggtcggccgcgtcccgggcccggaacacctcgccctgcccggtcgcccggaccgcctcggccatcgccttcacgtcgctcaccacgatcggcaggcgggcgtgcgaatattcgaagaacttggtgatcagcgcgatctcgtggttcggccagtgatggatcgggatgaccccgacatcggccggcgacaggaagcggaacacctggtcagccggcacgtagggcaccgcgtggacacggtcggacgcggcggtcagggcctggatgtgcggtgccgacggattctccacgaccagcgccagatgcaccccgggcagctcgggcagcgcctcgacgatggtgtccaggccacgctgcgggctggacgacccgctgtacaccagcagcggtgtcgccggatcaagaccacacagaagacgcagatcgggtacgtcgtcagctccggcctgcgcgggcgcgttcagcaccacgcccggcctggtcgccagcccgtgctcgcgctgcagcagttcggccagcgcgtccgagacggtgaccaccgcgtcggcgaacggcacgtactcccgctcgtacgccaggtgcgccggcagccagcgggcgttgtcccgccgcggccgtgccccgggcaggaactcgtgcgcgtcccagaccagcttcacgctccgcccggccgcggcggcccgctgcttggcccgcgcgcccaccccgagcatccggaagtcgtgcgcgtggatcagcgccggcgccagctcgtcgatcaccggaccgaacgcccgctcgtagttccacaggccgggctccaggcgccgccatgcgcggtcgccctctttacccagccagtacctgacctgggcgcgttcgaccggtttgcgcgccttgcgggccagggccagcggcagcccgccgcgctccaccagcctgcgcttgaggccgccgcccccaccggacgcgccaccgccaccgcccatcggcagcagccgcacctcggccgggccgatctgccagcggtgttcctcgtggtcgggcgagcagcccagcagcgtgacgtcccaaccggcctcggcggccgaccgcgcggtcttctggacccgcgagtcgccgttcacgccgttgtcgacgagcatgacaaccttcatgatggcgcgagtgtacggtcacccggccgagcgaagatcacgagaggcctcctgtgcaccgatccgactcccctgccgacgttctctacctggccctcggcccccggcgcctcaccgccgccggggcgcacaccgcccgcctggccgccgaggggcactccgtcaccttggccgtgaccagcgagaacgtcaacacccccgcgggcgtcacggtgcgccgggtcacctcgccggcgcaggcccgggcgctggccgaggccgccgaggtcacctatgcgggcgacgccgaagcgctcgccgcagtttacggactcgccacccgcctcgagccgtcggccgacccgcggcgccgtcccggccccgccgacctggccgtcgtcaccccctggtacccgtcgcccgacgacgcgttcgccggcgccttcgtccgcgccgccaccggcgcggtccgcgagcacttcgcccggatctcggtgctgcacacgcagagctggttctacccgcccggccggctgcgcggccagctcctcggcgtggccgccgaacgccaggcggtcagcagcggaaacaccgtcgtcttcgacgacgcggagggggaggtcgcgcgcgtcgcggtccccactccggccggcggggactatctggcgtacgccgacgagcagaccgccgcgctccgcagcgcgctgcccaccggccggatcgaggccccggtggtgcacgcccacaccgggatcatgggcggggtggtcgccgcccggctcgcccgtcccgacgcccggctggtggtcaccgaacacgccacgtatctgtccaaggtcttcgcccagcccggcgcgcggcaccgctacgcccgcatgctggaccgcgccgacgctctgctctgcgtcagcgccagcctccgtgaccagctcgccggcttcttcccggcgcacaccggcaaactgcacgtggtgccgaacgcgatcgatttcggcgcgttcaccgtccgcccggagccgccgaaggccccgcaccgctggctgtacctgggccgcctgatggagcacaagggcgtcctcaccctgatcgacgcgttcgccgcggtcgccgccgaggacccggcgctcaccctcaccctggtcggttccggtccgctcaccgacacggtcgacgccaggatcgcggcgctcgggctgaccgggcggatcacccggcgcccgccggtcgagccggaccgggtgaccgccctgctgcacgagcacgacgtactcacccacgccagcgtccgggagaccttcggcatgacgatcgtcgaagcggtggcgaccgggacgccggtgctcgtcgcgctcagcgagggcccggccgagacgctggccgggctgtccggggtggcgggcgagacgttcgcgccgaccaccgacccggcggtgatcgtggcggcctaccgccggctgcgcgacggcttcggcaccctcgacatggcggccgcccgggcggccctcgacgcccgatacgggcgggcggcggtcgcggctcagctgctcaccgcgtaccgcggaggttcttccggcgggacgccgatgccgatcccggcacgcccgcagcgatccggcgcggtgctgccggaggcagcgacccgtgcggcccgccgcgtcatccgcaaattccgctgatcacccctacgcggtggtgggcgccgccatcagatgcggctcccccacccgccgcgcgctcatgatcaccgcggtcaccgcaacggcggccggcacgagacatccggcgagaccgatcagcgtgcgggcgtccgggtggatcagcgactgcccccggttcacctgccaggccagcatgccgatcaggccgccgtacgctagcgccatgatcccgaccagccgccgccgcaccgcctcggtcagccacggccgggtccgggccgccaccgccagcagccccgcggtgatcagcagcatgtgaacagcgtgcagcccgacgaagtgcggcacccggatgtcgccgccggtcgcgttccagtgcgtgatcggcatcccggtcccgtccggatcgccgcccaccccgtgcccctgatacatcgtcaccgggcggccgttcgcgtcgagcacggtccgctggtggatgctggtcgccatccagtagaccggcagcagcatccccaccgtggacagcccgaggccggcgcgcatcgcccgggccagcgcccggtcaccggtgtgccgcagcaggaccagcaccacgatgatcagctgggtgaggaacagggttgctgtgccggatgccgaccgacggcgaggcggcggtgccgagcctgccccgggcgccgaacctgtgcgagatcatcggccgccgtgttcccaccgacggcctcacgagccggaatcatgcggggacagaaccggctcagcatccgctggtccacttccgccgcccgccgagctgctcgtgggcagagttccacggtagtgtggatgtcatgacggcggcgttcgaggatcttccgttcagcgagttcctgcaccggccggcggcggcggccgagcgcctggaggtggtgcgggcgctgcggctacgacgccgggatgcggatgacctcgccttgatgcgggtggagcagctggaccgggacggcgtggtggtggatttgaccgcccggctgctggccggcctggttcgcacgcagccgccgggagcggtgcgggcagtgctggccgaggcgttgccctgggtgacgttcctgcccgaggccgatgtcgaccagttgctgatggagctgatcgcggtggcgcagggcgcggcgtcgctggcgaacctgtcaccggtggcggtcttgctgacccagtggcggcacaccgcggaggtgcacgccgaccccgccctgctggagatcctcacccgggaaccggaaggagaccttgggcaggccgtcgtggggaccgaggtgcagtgagtccgaagcgaggtgatcgtgcggcgccaccgccggtcggtggcgagttcgacctgcggttcgccaattcggccgcggcggacggctgggaccagcttgcccggcaggcccccgccaacccgcgacgggctcatgacgcgatccgggccgaggagccggccgcccgtcgcagcgaccgattccgcccaccagcgccccttgttcagcgcatctcgtacgcacccaccagcgccagcacctgctcccacaccgcggcggtgcgggcctcgtcggcgaccgggcggagcacctgggcgagcgcccacgccgcctgctcgtcggtggtcgtcgtcttgccgtgcaggtccgtggcgtactgcgcgaagtcccggaccagcacctcgaagatcgcgtcgagcagctgagcgtcgaggccggtcagctcggcctgttccaggatcagctgcccgtagacgaccagtgcgaacagctggcccaccgacaggaggaagtccaggtcggcgtgctgctccggagccaccgacagctcgcacagcgcgtcggcctgccggcggaagcgggccacgttcggcagctcggcgaacttgtcgtaggcgatccgccagtcgtggaaccggatcgccccgagcccgcgcgccggcccctggcggaacaggaactcgtcgtccgcgggatcgtcccgggtcgggaccgggtcgtaggaaaccgggtggtgcaggtagttcggcatgaacttgaggatcagcgccaggttgacgtggacggtgccctccagcttcggcaggccccggatgtccatcgcggccttgtcgaagtaggtgtccgcctcgaagcccttggccgcgatcacgtcccacatcaggtcgatcacccgctcgccctcggtggtgaccttcatcttggtcatcgggttgaacagcaggtagcggcggtcgtcggggccggccgaccggaagtagtcgaccgcgcggtcgctgaacagcttcatggcgaccaggcggacgtacgcgtcggccagttcccgccgcacgtgcgggaaattcgtcaccggcttgccgtacagcatccgccggtgcgcgtgggtgaccgcctcgtacatggcgtgctcgcagatgccgatcgccgccgtgcacaggttgaacttgccgacgttcaccgtgttcagcgcggcgtcgaaggcggcctgtccggtgtgcaggatgtcctgctcgcgcaccgggtagtcgcgcagctcgaaggtgctgacgtacatctgcttgttcacgacgttcttgatcaggtggtacgacggatggcggctgtcggcggtgaagaacacgtagccgtcgtcggtcttgccgaacaccgacacgagaccggccacgttgccgttgccgatgtagtacttggtgccgttggcccgccaagtgccgtccccggccggggtgagcaccatgtcggtggcgtagatgtccgccccgtgccccttctcggacaggccgaacgccatcacgtgaccctcgtcgagcaggcgggcggcgtgcgcgcgggcgtccgcgttcgcgctctgccacaccggtccgaggcccagcacggtcacctgccacacgtaccagtaatcgagtccgtagaagccgaggatctcgctcagcgcggcgttgcgggcggtgtcccaccgcttgtcgccgtcaccgccgggggtcatgaaggtggcgaacagcccctccttggccgcgaagtccaggaagtcggcgtaccaggtccggttgatgtagctgtcgatcagcgcccgcttgccgcgcgcctcgaagaagtcgacggtggcgcgcagcaggcggcgggtctccgcgtcgaaccgcgcgaagtcggccgtggccgggttgaacagcactggtcagaattcctctcggagcgtggtgagaacgtcgtcgagccaggcgaggagcatccgctcgtacgcgatgccgccgcgcagcacgacgtgctgaagcttctgtccctttttttcggagaaatcgcgtttttctccggcgaggtagcgggccagcagatcctcatgctcggcgcggtagcggaccacctcgtcgatcagcgccgcccgcccggccgcgtcgtcgaacgccgccccgcgcaccttgaccgccaggtcgtgccggaccgcctcgggctgcaccggctcgtgcagccagccggtgagcaccgcgcggccggtgtccgagacggagaactcccgcttgtcgggccgcccgtcctggccgacctccagcgcggtgacccagccgtccgcctccatccgcttgagcacccggtagatctgctggtgggtggcggtccagaaccggccgatcgaccgctcgaagcggcgggccagctcgtatcccgagccgggccgctccagcagggagaccaggatcgcgtgttccagggccatgcccggcatcatgctatgcaacttgttgcatagcaagcgggtcagcgattccgctcccgttcccacgcccggcgcgccgaccacgcctcgatcagcgcccgcagcagcggcagcgcccgctcggtcgccacccggccggcctgttcgaattccgggatccggcccagttcccagaacgcgtactcgtccacctccgggcagagcaccaggtcggactcctcggccagccggtcggtgccaccgggctgcagcgtgctgaccgccaccatgatgtgcagcagcgtggtcggcggccggcgcggcagcggcccggagacatccaccgcgatcaccaggtcggcgcccagccggcgggccgcggcggccgggaccatggtcaccatgccgccgtcgaccagcagatgcccgtcccgctccaccggggggaagacgcccgggatggccgcgctggccagcaccgcggacgccaccgggccgtcggtcatcaccacctcccgcccggtggtcaactcgcacgccaccgccgcgaacggcagcttcagatcggcgaagtccacgctcgccagcgacgagtcgaggaacagcccgagcttgctcgtctcgaagagcgccttgcgggtacgcccggggcgcaccagccgcgcccaccgcaacgtctgcgccagtgaggcgatctcggccggcgtgcgaccggccgcatacagcgcaccgaccagcgcgcccgcgctcgtcccggtgaccaccgagggggacaatccggcccggtccagcgcgtccaggacgccgatgtgggcggccccgcggaccgcacccccgcccagcgccagaccgatcctgatcggctcgtccacgctcacgccggcttcagctcgaccgggatgccgttcagcaccgagttgccggacagcgggtccaggaccagctcgtcggtcagcacgttggagttcaccccgggatgcgccgcggccaccgccagccgcaccccggacagcgagtgcccccacccgtgcggcaggctcaccacgcccggcatcacccggtcggtcacctcgaccggcgccgccaggctcccggcccgcgacgacaccgccgcggacccgccgtcggccagccccagccgggacgcgtcggccggatgcacctgcagtgtgcaccggtcgcggcccttcaccagcgccggtacgttgtgcatccagctgttgttggaccgcaggtgccgccgtccgatcagcaccatctccggccgggggcggtcgaccgcggccagcagccggtccgcctcggcggccagctccggcgggcacagctcgaccagcccgctcggcgtccgcagcacctccgggatccgcggccgcagcggccccaggtccaccccgtgcggggactcgatcagccgccgcagggacagcccctccggcgcggcgccgaacaggtcgccgtacgccccggtccgcaacgccacatcgagcagccgctccgccgggccgtccccggtgaccaactcccgcagttcgtccaccggccgtccggtcgcctcggcgaccttgccgagcgctccgctcagcagcgcctcgtgcaggtcagccggctccccgtcgcgcccggaaacgatcagcgtcagctgcgccaggatgtcgcactcgtcccgctcgtcgggccgcggcggcagcaccggcggcgagtacgccgcgaaattgcgcaccgcgagggccaggaacgagaagtcgtagtgccccttgcgggtcgcgtccagcggcggcaggatcacgtcggcgtgccgggtggtctcgttcagatacgggtcgacactgaccatgaagtcgaggccggccagcgcccggtccagccgctcactgttcggcgtcgacagcaccggattgccggccaccgtcagcagcgcccgcacctgtccgtcacccggcgtctcgatctcgtcggccagcgtcgccaccggcagctcgcccttgacctcgggcagcccgcgcacccggctgcgccaccgcccggtgcggaacccacgcccgccggacgagccgcgccgcagatgcgcggccagcgggaacatcaccccgcccggccggtccaggttcccggtcagcacgttcaccacgtcgaccagccagctggtcagcgtcccgaactcgaccgtgcaggtgccgatccgcccgtagaccgcggcggtcggcgcagccgccaactcgcgggccagcccgcgaatccgctccgcgggaacatcacagaccgcggcgacccgctccggcgggaaactcccggccaggcggcgcacctcgtcgacaccattgacgtacgacgtgagcccgcccagcttcgtcagcccctcggcgaacaacgtgtgcacgatgccgaacagcaggaacgcgtcggtccccggccggatgaacaggtgctcgtcggcgtgctcggcggtccgcgtccgccgcggatccaccaccacgaaccggccgccgcgcgcctgaatggccttgagccgccccgggaagtcggccgccgtggccaggctgccgttcgactcccacgggttcgcgccgagcaccagcaggtagtcggtacggtccaggtccggcaccggaatggccagcgggctgccgaacagatagccgcacgagacgtgcttcggcatctggtccacggtgctggccgagaagacgttccgggtgcccagcgctttcagcagcggcgtcacatacagcccgccggccatcgtgtgcacgttcgggtttcccaggtatgcggcgacggcctgcggcccgtaccgctcgacaatcggccgaaggccttcttggaccgcggcgaacgcctcagcccaggagacctcctcgtgccgcccgttccggcggatcatcggccggcggagccggtcgggatcgtcggtgagccgcccgaaagtcgcgcccttggggcagaggaaaccgccgctgaaaacatggtcgcggtcgccgcggaccgcggtcaccgtgccctcgtcgacggtcagctccaggccgcaggccgcctcacagagcggacacgtgcgatacgccgtgtggctcacgtccaccaccttccgatcggggttaccggccagtatccgccatgggaggcgggtccgggtcatcccatcggccccggctcacgtcttgacccgcaccccggggtacaggtttagcgtcaccccgtgacgacgaccgacatccggccatacctgcgcggcctggccgtgttcgccggcgacctgcccggcttcgacccggccgccgccccgccgcaccccgagaccctgttcgtcgactggctcgtcgcggcggtcgacgccggtgtccgcgagccgcacgccatgaccctgtcgacgatcggagacgacggcgtccccgcggcccgggtcctgatcctcaagaacgtcgacgccaccggctggcagttcgccgtccacgcggccagcccgaaaggccgggatctgagccggcacccgggcgcggcgctcaccttctactggccggcgcaggcccgtcagatccgggtccgcggaacggtccgccccgaaccgcccgaccgcagcgccgccgacttcctggcccgcccggccggctcccgcgccgaagcctccctcggccggcagagccgacccctcaccgaccgggaaaccctggactcggccgtgcgggcggcccacgagcggatcctcgccgaccccggacacgtcgttccggagtggacgctgcacaccctgaccgccggcaccgtcgaattctggcagggcgaccatcagcgccggcacacccgcctccgctacacccgcaccgaccccacctggacccgcgacctactctggccctgacgatgcggttgtcggagggcgctgtggacgtggccggtggccgggagctcacgtgggacgggtgtgtcaacgttcgcgatctgggcggcctcggacgggtgcggcccggcgcggtggtccggatggaggcgccgacccgtctgagccggcacgggtgggcggcggcctgggcgcacggggtccgcaccgtggtcgatctgcgccatgcgagcgagtgccggccggaggtcgcgtcgagaccgccgggcatcaccacggtgcgggtcccgctggagccgccgggtacaccgttctacgagcgctggcagaggatcgacaatctggcgtcaccgctgcactacccggcgatgctggccgagcaccccgaactggtggtcgccgccgtccaggcgatcgcgaccgccgccccgggatgcgtggtgttccactgtgccggcggaaaggaccgtaccgggttgctcgctctggtgctgctgaccttggccgcggcgacacccggggagatcatcgccgactatctgctgactttcgaccggatgaggcggcggtatgccgaactcggtgccggtgaccagctcaccgctgtcaacgagctgctcaacggccacgacaccaccatcgcggcgtcactgaccgcaactgtcgaggcactgacaatgcccgactatctcctcgacaacggtctgcccgaggccgacctcgtggccctgtacgcccgcttgacaacatgttgagccggcatccgacggcggtcgtgtcgcgggtgaggtggtcgaggaatccgctggttcggcgacggcgggggccagggctgccaggcgcctgcccctaccgagcatgccgatggccgggcatcgcagatcctgtgtccggaccccggcggtgggctccgctacctcgcggccggcggggtgaaatccttggcgagcagggcgtataccgctacgtcgcgggggccgtcggggaagcggaccgcgtcgcgcagcacgccctcgcggaggaagccgaggcggtccgccagacggtggctgcggtggttggtggtcagcgtgcgcatctcgacccggtgcaggccgaggtcgccgaaggcgtggtcgagcacggcgtgcagggtgcggctgacgattccacggccctcggcggcggcgtcgacccagaagccgagctcggcggatgcggtcggcgcatcgatggtcaggttcgtcgcgccgaccaggttgtggccgttgccggtgggcacgccgatggcgaggggcaggcgtgtgccggcgagccaggcggccgcggcggtcgccagggcggtgcgggtgccttccggggtcggttcaccgagacccggcgaccagagcgccaggcgggcatggttggcggccagcagggcgtggtacgcaatggcgatcgccggggtgcgcggcatcaggaccaggccgtcgccgatcggccagacgaaccgggcactggtaatcggcattgcacggatcctttgacgtccggcggacaggtgccgcgaccgggccgagatttcgttgtcgatcgacaccatagcgtccggtcggatggccgggccgccgcgatgttgctcgagtcttttcttcttcccggattcccggcggtggcgaccccggggttgcatccggtacctgggtacaggcttaccgtcgacggcatgacccctcctgaagacgatgcgtgggtgccggaagcgtgcaccctgcccaccgctgaccggccgctgcgggtggccgagttcgacaggctgttcgccaccgcgctgcgcgggcagcggcggctttcgcccacgacgctgtgctgggagctggatccggctgccgaggcggaggctcgggaggcggccgggcgggagagcggctgctgctcgttcttcaccttcgccttcgaggcggatgcggcggcgctgcgggtgcgggtcacggtcccggccgggcagatcggtgtcctggacgggctgcagcagcgggccgccggacaggccggtgcccggggcgggctccgccggcaggccggcgggcgggtgcgggcgtgagcgggctgcggagcagccaggtggccgaggcggccggggtgaacctgcagaccctgcgctactacgagcggcgggggctgatcgcggaaccggagcgcagcctcggcgggcaccggctctatccggcagaggcggtcaccgtcctccgggtgatcaaggcggcgcagcggctcgggttcacgctcgacgaggtggccgagttgctcgcggccggtcggcatcggcatgggcggccggacgccgggcttcaggagcgggcgaaggcgaagcttgccgaggtgcaggcgaagatcgccgacctggaggtgatcgccgggacgttgcgggcggcggtcgatgccggctgtgacgatctggtcgcctgcgccgggcaaccgtgctgtccgattccgttcgtcaccatcgcgggggccgccggatcagcggccgggccgatgcggggaggagtcgaggatgtctctcgctgaccgcgtgcgtcgcctgctgcccgccgggctggtcggtctcgccggactggcgtgcgccgcctgctgtgccattccggcgctgctcgccgccggtgccgtctccggggccggctgggcggccgccggagaccggatgccgggggcggctgtcgtgctcgccgtggccgccggcggcgcctggtggtggacggcgcggcgacgccaccgcgccggatgcgccggcggcggatgcgcctgcgcgacacggtgacccagccgtccggcccccgcgccgtcccccgtccgggtcgtccgtccacgccggtcacccagccgacactcatcggccacgggaccggcgcacactcggccctatgggtgtcgacctcggtggtggaatcgagttctacgcgggccccccggtgttgggggcgccggacgacctggacgcggtcatccgcgggttcatcgacggtgcgaccagccggctgctgatcgcggtgcaggagctggactcgcggctgatcgcggagaacatcctggccgcccgggcgcggcgggtacggacgcagatcatcctggagggcgactacctgcgggaggagaaaccggtcgccgacccgtgggcggccaccggggagaacgagggcaaccgggtgatccacgcggcgctgctgcgcgccgggatcgacctgatcaccgacctgaacccggacatcttccatcagaagttcatcgtccgggacccggggaagccgaccgcggcggtgctgaccggctcggccaacttcacccacaccgacaccggcaccaacccgccggacatgctcgacaagccgggcaacaacctgaaccacgtggtggtgttgcacggcaggcaggcgaccgacctctatctggccgagttcgagcggttgcgcagcggcacgttcggggcgctgcacgagcgggtcgagccgcgcccgagcgagttccggctcggcgggctccgcgtcaaaccggtcttcgcgcccgatcaggggccggagatggagatcatgaagcagatgctgaaggcgaccgagcgggtcgacttcgcgatgttcaccttcgcccagtcgtccggcatcgacgacacgatgggctggatgctcaaggccggcatcccggtccgcggcgtcctcgaccgggggcaggggtcacagaagtgggcggccacggtgccgttgaagaaggccggggcgcagctgtacgagaacacgccgggcaacggggtgcgcaaagtgcaccacaagctgatggtgatcgatcggcggctgaccatcgtcggcagcttcaactacacggcgccggccgccaccctcaacgacgagaacatcgtcgtcctcggcgacctggaggagaccgacccggccgcgatcgccgcgcaggagaggctggccgggtacgcgctggccgagatcgaccggatcatcaccgagctggcccgccccgcgtgagtttggcggtgcgggaagaccttccctagagtgggcggtcgggcgccgcggccgcggcgtcccacggcggggaagggacggcacgatgcgcaagttcgtggccggaatggcggccatgacggcggcgctcacgctggcggcctgcggcaacggcaagagcgacgagccgtacttcgtcggcgaggcaagctcggcggcgccggccagcgccgcgcccggccccgcggagtcggccacggcggagagcagcagcgcgccggtcacggcgaagagcgcgagccccaagcccagcgccaccaccccggtgaacgtcaagtacgtgttcccggtggtcggcaacaactcgtacgcgcacacgcaccacgactacccggccagcgacgtgatcaccaactgcggcaacacgttccgcgcggtcaccggtggcaccatcctcgccgtcacccgcgtcgacacctggaaggcctcggtcaacgccggcgccacccgcggcggcctgtcgatctcgctgctcggcgacgacggcgtccgctactacggctcgcacctgtcgaagatcgacgccaaggtgcaggtcggcgcccgggtcaccgccggtcagacgatcggcaaggtcggcgataccggcgacgcgagcgcctgtcacctgcacttcggcatctccccgccgtgcgcccgcaccggcgactggtggaaccagcgcggcaccgtctacccgtggccgtacctggactcgtggaaggccgggacgaacaagtcgccggtcgacacggtcaagaagtggaaggccgcgcacggctgcccgaccaagccgaccgtcgacggctgaccccgggccacccggtcaggcgggtgacgcgacgggggccggccggcgggacggccaggtgagcaggacggccaggatcgccacggtcgccgccaggccggcggtgccgaccaccaggctcgggcgcagcgactcggcggccgcgcccgccgccagcatggccaggccctggatgccgcacaggccggacatcgccacgccgaacgcgcgggcccggtaggcggccggcaccgcccggccgaacagcgagttcagcgggacgctgaacgcgccggccaggccgctgacgaacagcagtgccagcaccaccggccgcggcgggtgggcggccaccggcagcagagcggtggtggagagcaccgccagcggcaccatcaggcgcggaaggccagggcgaccgcggtcagctgatcgccgatcagcgacagcaggttcgcggcgaagaggtggcggtattcgcggacggcgaagatctcgcggtatccggccggctgtccgggcaagcgatcatccctgtggcatgggtcgacggcgggtcgtcccaggtccagttgggacgtcccgccgtcgctgacggtcaactcggttcagctccaggtacgaccacgcatcgggcacctccttagaccggcgtctcgccgacgccgatcaccgtacgatttctcaataattccggcatatcgtcttttcgtccggcagggtggcaaccggtcggatttcccgatgccggaccgggcggccgcggcatgcccggtcgggcgggtgccaggatgtccgggcgggcggggcctgaaggatgcccggcgggcggggcctgaaggatgtccggacgggcggaccggaaggatgtccgggtggcccgcgctcaggtggccgggcgggaggccgatggaaacgcgccgggcaccgcggggtggcctgccgagaacgaccgagccgagagagcggagagcggatgcgctggccccgagccaccgcgccggcgtggatcgtgcacgccggcttcgtgacgtccgcgctcgccggcggcgtcgggtacgcgctcggcggggcacatgcccgggcggtcgtctacacgctgatcgtgctgctgtcgatcgggctgttcgggcaggcgctgctcgccgggcacctgacccaccggcggccgtggctggtcgcgatcggcggtttggtgctgctgctcgtcgaccacctgatctggccgtactggatcatcgacggccacctgggccgggccgagggccgaccggccgacctggtgctggccgccgcgcacggactgttcctgatcggcgcgtcgatggcggtccggcaccggatgagcgcggacgccggcggcatcgtcgaagccgcgatcttcggggcgtgcaccggcggggcgctgtgggcatgcctgttccagccgcacctggcggccaccgccaccccgatcggggcggcgcaggtgctgaccgacgtgctggtgctctgcgccgtcgccggctgcctgctccggatggccgtggtcgccaccggcccggcccgcggcaccctgggatatctgctgctcaccgtgctgctgaccgggtcggcgctggccgtggggtcggtcggggcaccgcaccgcggcacgttgtccggcctgttgatgctgatcgccttcctgaccatcgggttcggcgcggtgcacccgggcgcacccgccacggtcgaacccgacacggtcaccgaacgccgccccggccgcttccggctcagctggctcggcgccgcgctgagcgtcaacccggcgatcgccgcgatccaggccgcgcacggcgtcgccgcccccgacccgcagctgcccgtcgccaccctgctggtcatcccgctcgtgatggtccgtttccgccagctcaccggccagcgggaacgcgccgaggaggtgctcgcctaccaggcctcgcacgacgagctgaccggcctgttcaaccgccgccggatcatggccgagatcgacaccgcgctgaccggtccgcacgacgtgaccgtcctgctctgcgacctcgacggcttcaaaccggtcaacgaccggcacggccacgccgccggcgaccacgtgctgcgcacggtcggcgagcggctcaccaccctcaccggcccggcccacgccgtcggccgcctcggcggcgacgagttcctggtcctctgccgcggcggcaccccggacgagatcgccgcgctgcgcgccaccatccaggccacggtgctcgccccgatcaccctgcccaccggatcggtcgcggtcggcgtcacgatcggcacggcccaggccccggccggcggccggaccgaccgggcgacgctgatcgcccaggccgacgcccggatgtacgacgccaaaccccgccgccgccatcccgccgcctgatcctcctcctcaccgccgtccgcccgaccgacgcaccccaccgcggtccgtctgaccggcccgccacgccccgcccggccccgaccgcgcaggtcggagatttccggcggcgggaggctattcgggttgcccgggatgggtgggatcgagcaggctggccggcatggatgcgcctgagatgatcaacgcgggggagcttgtcctcaaacgctgggagccggagtgggccggcgagctgaccgccgcggtgcgggagtcgctgcccgagctgacgccgttcctgccgtgggcgcacgacgactacggtccggaggacagccggtcgttcatcgccaggtcggtggagaactgggacgccgggaccgagttcaactatgcgatcttcacgaccgtcggcgaggtgatcggggcgatcgggctgatgaccaggctcggtccggggacgctggagatcggctactggctgcgcaccccgtgggccgggcaggggcggatgacggtcgcggtcggcgcgctgacccgggtggcgctgacgctgccgggagtgcggcgggtggcgatctgctacgacgaggcgaacaaggcgtccgccgcggtcgccgcgaaagccgggttcgtcgaggtcggccgggagcaccgggagccgaccgccccgggcgaaacgaacatcctggtcaccgccgaacgcaccgccgcctgaccggcgtgcggggagcgggtcgctgacgagccgggtccgcagcgaccacccggcccgtcagcgcgaggcgccaccaccgcggcgccgcaaaccggacaggatggtgatccgcccgtcccggcggatccgcgacccgaccgccgcgccggcaggcccgcatttgtcatgatgcgcgtcccaccgaaaaaaacgccaatcacttcattcaggaagatcaaggtcgggccggcgaagaacgggtcgccatggcgtaacaacctggggtgatactgcaagcacggacgggccggcagggcggtggttctcgatgctgcagcgtttgatccacatcggagcggcggtgatcatcaccgcggtcgccaccacgggatgcgccgccccgaaatacacctacgtcaagaactccgagcagaagacgtacttcaaagttccgcacgagtggcacgcgaccgccaccggcgacctggacgacgttctcagcggcaccaaccccgactcggccaacgcggccgcccgccagcagatgtggtggtcggtggcgtacgacgcggacgccgacccgaacgccgggcacctgctcaccgggcgggtcaccgaccagccgatcgtgtacgcgcgggtcgccgagctcaccgagcaccagcggaacgcgatgtcgctggacacgctgcgcgacctgttcctgccggtcaccgccgacgcccgggagtcggccgcgcagaccagcacgctcagcggcttcgagctggtccgcgacgaggtgctcaccccggccgccgggctgcacggggtgcgggtggtcttcgactacgagctgtccgacggggtgctgcacaccttcgaccagaccgcgctggtcaacaacaccggtgacaagctgtatctgctgatcatccggtgctccaccagctgctacaaggaccggtccggcgagctggacacgatcgccacctccttcacggtgaggagcaagtgatgccacgcgtcacccgtaagcggctgccgttctgggaccgggtcaaattcctgctgctgttcgcgatcgcgttcttcgccctggtctggacggacatggcggacgacccgctgctgccgttccaggatgcgctctacaaccggctgcacagcggcgtcggcgtcggcatcatcgtgctggccggcctggaggtgttgcgccagctgcactacctgcactccgagcacgccgcctggtatcaccgactgtggacgcacggcatcttcggcggcgtcgagcggctcacccaccgggtgttctccgactggacccggttccggctgctgcgggtgttcaagtggctgctgttcctcggcctgctcgcggtggtgctcggcgcggtgctggacacctcgccggccatggccgtcttcggtatcccggccctgctgtggcgggccgccccgatgttcctgcaggtcatcttcatcctgttcatcgcggtcggccagttcgcggcgatcttctggttcctgtcccggggcggcgtcgaggtctactacccggacgacgtgaagacccgcttcaccgacgtgtggggtcaggaccacgtgctggaacgggtcaaggagaacatcgtctacctggagcggccggaggcgatcgagggccagggcggttacgtgcccggcggcatcctgctgtgggggccgcccggcaccggcaagacgctgatggccgaggcggtggccggcgagaccggccggccgtacgtgttcgtcgaccccggtgcgttcatcaacatgttcttcggcgtcggcgtactcaaggtcaaggggctctttcgcaagctgcgcaaactcgccctccgctacggcggggtgatcgtcttcttcgacgaggcggactcgctgggcaaccgcggggcgctcgcccagggcggtccgggcggcggcttcccgcgcagcaccccggccccgttccgggacggctgccacggcttctcctacctctccgaccagtcccgctggaacctgacccgcgactcggtgatgtacggcggcgggatgggtggcggcggtggcggcatgggcaccctggaggcgttgctcaccgagctgtccggcctgaagaagccacgcggtttcgtcaaccggcacgtgcgccgggcactgggcatgcggccgaagccgccgccgaaataccggatcctggtgatgatggcgaccaacctgccggaggctctcgacgaggcgctgctgcggcccggccggatcgaccggatctacaaggtgggttacccgtcgaaggccggccgggtgcgcacctatcagggctacctggcgaaggtgaagcacgagctgaccgaggagcaggtcgacaagctggccacgatcacgccgtacgcgaccggcgccaccatcaaggacaccgtgaacgaggcgctgatcaccgcgatccgcgacggccgggacaccatcacctggcgcgacgtcatcagggccaagcagctcaaggagctcggcccggcggagaacgtggagtacatcgagcgggaacggcacgcggtcgcggtgcacgaggcgtgccacgcggtggtcgcgtaccgaacccggcaccacatggagatcgacatcgccacgatcgagaaaggcagcggctacctcggcatggtcgccagcatcccgccggaggaccagttcaccacctggcgcagccactacgagtcggacatcctggtctcgctcgcctcgctggccggggaacggatgttcttcgacggggacagctcgtccggggtctccggcgacctggagtcggccaccgcggtcgccaccaacatggagggcgtctggggcatgggctcgacggtgtcgtcgtacgccgcctccagccggctcggcaccggtaccccgggcgcgctgcccaagggcgacaagaacgacctgtccgcccggcgcgcgctcgccgaccggatcgaggacagcctgggcgagatgctggaacgcgccgcgaccatcctcaaggagaaccggcgcgaggtgctggcgctggcccacgcgctggagacgcacaagacactgaccggtgaggacgtcatcgcggtgctcgagggccggccgggcccgctgatcgacggcaccgtctacgccgacgaccggttcatcgccgaggtggagagctaccaccgggccgcgctggcagcgcatcgcgggcacggccggctgagcaccgcgctgccgtcgcgggccgtcccggagccgctgccggtcccggtcgacgggccggccgacctgccgaccggcagtgagatctggcgccgccccgacccggtcgacgccaacggcgccaccccggaaatcccgcagcaacgagactccggcccctcctgatccgccgattgcgggggtacggcgcgagcccgcccggcgtcccggccccggccgcgacgccgggcgcgatcatgaatgagggtggcgcccggtgggtagggtgacccgccatgagtgctgatgcgatcgtgacctaccggacgagcgcggacggccgcacgctgcacgcgctgctgctcgccccggagctggacgtcgacgtcgccgacgagctgcgcgacagcctggagaaggcggtcgccggctcaccctgccgggagctcgcgctggacctggccgaggtgaccttcatcgactcgtacgcgctcggcgccctggtcggcgcccgcaactcggcggccgccgcgggcctgacgatggtgctgacccggccctctcccccggtccgtcaggcgatcgcggtcaccggcctggccgaggtgttcggcgtcgagccggtctgaccgcggcacgccgagcgaccgcggcggcggtcccgccgcgccacgggaactgaccggatctcggcagccgggggcgccacgggaaccgaccgggtcgcggcagccgggcgcgctagctagctaggtcgcggcggccgggcgcgccacgggaaccagccgggtcgcggcggccgggcgcgccagccgagtcgcagcagccgggtcgcagcggccgggtcagagggcctgcgaccagagatagacggccaggccggccgcggcgacggcgatcgcgatgcgcagcgggcgttccggggagcggcgcacgacggccgggccgaggctgctgcccagcatgcagccgacgccgagcagcagcgcggccggccagtcgaccggcccggtcagcgcatagaggacggcggcggtcaggttcgcggcgcccagcacgatcgtcttcaccgcgttggtgaccgcgaacggttcgctggcggcgaccgccatcgcggccagcagcagcaccccggcggccgccccgaagtagccgccgtagatgccgatcaggaacgtggccagccacagcggcggccgccggccgggccgcgtgtaccagtcctgcagtccctcgcggaacagcagggccagcgcacccagcacgatcaggaacggcacgatcagcgcgaacgccgacgacggcgtgatcttgagcagcaccccgccggtgatcccgccggccgcgcacaccacactcgcccggacgatccgcggcccctgcccgcgcagctcacgccgggcggcggccgcggtgccggccggggcggccagcagcgcgaccgtgttggtcatgctggcggccaccggcggcaggcccgcggccagcagcaccggatagctgaccagcgaagccagcccggcgatcgacccggtcagcccggagccgacgccgccgagcagcagcagcgcggcatgttggagatccacgtcggccgagcttacggaccctcccggtcaggcccgcgaccactgccgggtcgtcgcaccggtggcgcaggtggcctgttccaggtcgaccgcgtcggccgccagggtcaggcatccgcccgaatggcgggccttgagctggtagtagccgccggtcgggagccactgccaccgctggttgccgccggtgccgcaggtgtactggatgatgtcggcgccgtccgcgatggagccggacgccacgtccaggcatctgccgctgttccggttgatcagctggacccagccgctgccggtgctacggaagtcccactgctggttggcgccgccgttagacacgtacgtctcgactcggcgctgtcgccgccgatcgtggtgagccgctggtcgtaacgctccctgcggctcggtaacagcacgtgttcgtgagcggtcaggttcccggccgggccgaacgtagtcgacgtcactctcctcggcacgatcatcgaggcgccgcggatgggaaaatcacgcggtgcgccgagcgatcgtcagtctgctggtcgtctgtcagagcacccaggcgttgatcttcggcgggatcgcgctgttcctgccgctgatccggaccgatctggggttgagcttcggccaggccgggaccctcgccgcggcgagcagcctgacctacgcgctgatgcaggtgccgtccggcttgctggccgaccggttctcgccccgcgtgctgttcctgaccgggctgctcgggacgaacctgctggccgcggcgttcgcggtgctcacgtcgtacgacatgctgctgttgaatcaggctttctccgggttcttccgggcgctggtcttcgcgccgggcctgctgctgatcagccgggagtttccggatgatcgacgggcgaccgcgatgggcctctatgtggccggcggcttctcgtcgaacatcctgctcagctcgacgggtccgctgctggtcggcccgctcggctggcggctgctgttcgtgctgttcgccggcgccgggctgctggccctgctgctctaccggcgggccgccggcccggccgagccgaggccggcgaccgaccacccggcccggatcggcgacctgcccggcctgctgcggcaccggatcgtctggctgaccgcggtgatccagttcgcccggctcgcggtggcccagggcttcaccttctggctgcccacctggctggtggtcgaccgcggacagtccctcgcggcggccggcctggtcgcggcggtcggtgccgccctgaccgccccctcgaactacctgggcggttacgtgtccgaccggatcgggcggccgctgctggtgatcagcggctcgctcgcggtgctggccgtcggcttgacgctgctcacctacgtgcccggcctgccggcagtgctcgccgtggtcggggtgatctcggtggtcgtgcaggtctatttcggaccgttgttcgcgctgccgatcgcggtgctcggcccggagcgggccggcctgctcagcggtttcggcaacttctgcgccaacctgggcagcttcgccttcgtctacgcgctcggcgcggtcaaggacgccaccggctcgttccgggccggcttcctcagcctggccgccctctgcgtgctggccctggtcgccgccgcggtggcccgccgcgtcccggccccggcccggcaggtctgacgcgctgccgaaactctcggtggatcacgaaaggtgaccgccagttcagctgttgacgtttatagatgcatggctatacgttaccgggaacgatcggcatgtcaccgaaagtttcggaacgcttcatccaccggaggcgtaccccatgcgaagccatctggcgggcgcggtcgccgtgctcgccgtcctgtcccccgtccccgcccactcccccgcccccgcccccgcccccaccggctacctctccacgcacgccgggccgggccgtttcccgctggccggcgctcccctcctgaccggcgccggcgattacccgggggtgctccgggtggcgggtgacctgcggtccgacctggccgccgccaccggcgccacggaaaagggcggccgcgacccgatcatcgtcggcacgatcggccactccaccctcatcgacaagatgatcaacgcgggccggctcgacgtccgcggcatcgccggcaggtgggagacctccctcgaacaggtcgtcgaccacccgttgcccggggtccgccgggcgttcgtgatcgccggcagcgaccagcgcggcaccatctacggcgcgtacgacgtgtcccggcagatcggcgtctcgccctggcacttctgggacgacgtgccggtgccgcacgccgacgccctgtacgtcctgcccggccggcacagccagggcaccccgaaggtcaagtaccggggtttcttcatcaacgacgagaacccggacaccggcacctgggcgcccgggttcttcggcccgggcaaggcccccggccatccgggcgggctgaacgcgaactactacgccaaggtcttcgagacgatgctccggctcaaggccaactacctgtggccggccgtctggggccgggcgttcgccgaggacgacccggccaaccacgccaccgccagctattacggcgtggtgatgggcacctcgcacgaggcgccgatgatgcgcggcatcgaggagtggaaccggcatcccgccggcaccggcgagtggagtttccgccgcaacccggacgcgatcaaggactactggcgggccggcatccagcggatgcacgatcaggacatcgagggcgtggtcacgctcgggatgcgcggcaacggcgacgtgggcctgcccgacggcgacggcatcgacctgatggactcgatcatcagcagtcagcggcggatcctcgccgacgcgggcatgctcggcgtgccccaggtgcagaccctctacaaggaggtgcagcgctactgggatcagggttaccggccgccggacgacgtgaccgtggtcttctgcgacgacaactggggcaacatgcgcaagctgcccgacccgtcgctcccggcccgtggcggcggctacggcatgtactaccacttcgactacgtcggcgacggccgcaactacaagtgggccgacaccgtgaacctgaccaacacctgggagcagctgaaccgcgcctacaccgcgggcgtggaccggctctgggtggccaacgtcggcgacctgaagaacgacgaggagcccacccagttcttcctaaactacgcgtgggatccggacgcgatcccggtcaccgggatcaacggctgggagcgccgctatgcggcggagaacttcggcacgtcactgtccgccccgatcgccgaggtgctttcccggtacggcgttctgcagtcccgccgcaagccggagctgctcaatcgccggatcacggtcgacccggcggtggacccgaggacggatccgagcgcggtgcgctacgacgaccagggcaatccgttcagcctcaccgcctaccgggagatggaccgggtggtcgccgagtggcagacgctcgccgcccggaccgagcggatccgggcccgggtgccggaggccctgcgcgacgcgttcttccagctcgtctactaccagatcaaggccaccgcgaacctctacgagctgcgccgcgcggagttcaccaacatcgcgtacgcggcgcagggccgggccgcgaccaacgacctggccgacgaggcggaggcccggttcgccgaggaccaggcgctgaacacctactacaacaccgtgctggccggcggcaagtggaaggactggcagctgcagccgaagatcggctacggcaacgtggcccggtacggcccgaacgcgccgtggcagcagcccgagaagaacaacgtggcgctgcccgacgagatctacccctacctgaaacggatcgaggtgccggccggggcgtcgctgggtgtggcgctggacggcggggacccgagctcgctgcccgagttcagtccgtggcaggcgcagccgggacagtacctcgacgtctacaacagagggacgacgccgttcgcctacacgatcaccgccgggcagccgtgggtgcacgtcaccccggccggcgggaccgtcaccaagcaggtgcgggccttcgtcacggtggactggcggcgcgctccggccggggtcaccgacgtaccgctgcgggtggaaggcgcgggaggcgcggtcgtgctgcgcgccccggtccgcaagccggtgaccacgccgcggggcttcgcggaggccaacgggtacgtgtcgatcccggcgaccgggttcgatcaccacaccggccggtggcgggtgctgcccgggatcggcaagagcggggacgggatcaccccgctcgccgccttcccggccgccgggcagccgggcagcgtcggtgaccgcggccagctcgactacacgatgacgctgaccagcgccgggccggtcaccatcgacacgatgctgatgccgcgcaacgggcggcagcggtacgcgatctcggtggacggcgcacccccgcagaccgtcgacgcggtcgccgcgaccggggcgaacgacaccacgatgaaccgccagtgggcccgcaacacctcggacaacgtcaccgtcaccgccaccacccaccagatcgccgcggccggtccgcacaccgtgtcgttccgggcgctcgatccgggcgtcgtcctgcagcgcctggtcgtcgacaccggtggcgtcaaggacagctatctcggcccgccgaccagccggaggtaccgaccatgaaacgacgtgccctgctggccggctccgccggagccctggccgccggcgtgccgctcgacaggcaccggccggaacccgcctgggtgcacacctggaccgcgatgccgcagctcaccgagccgggtaacctgccgccggcgccgttcaccggcagcgccgcggtgctggtggacaccacgatccggcagaccgtgcacacctcgatcggcggccgccggctgcgggtccggttctccaacgcgttcggcaccaccgacctgccgatcgacggggccgcggtcgcgctcccggtggacggccgggccggcgtcgcggcgatcgtcccgaacagctcccgtcggctcaccttcggcgggcagccgtcggtggtggtgccggccggggcccaggtggtctccgacccggtgccgatgccgatcgcggcccgggccgacctgaccgtctcggtctactccggcgccgggcaggccgggttgaatctgacctcgcatcccggctcccggaccacctcgtggctggtcaacggcgacgcgctggagcagcccgacctgaccggcggcgccgcggtcgaccactggtacctggtcagcggcgtcgaggtgatcgcgagccgggcggccggcgtggtgatcatcggagattcgctgaccgacggccggggctccaccatcaacggcaacgaccggtggcccgaccagctgaccgcccggctcggcgacccgcggctggccgtgctcaaccaggcggccggcggcaaccgggtgctgcacgacgggctcgggccgaacgtgatggcccgcttcgaccgggacgtgctcggtgtcagcggggccgcctgggtgctggtgttcgagggggtcaacgacatcgggacggccgcggccaccgaggccgagcagggccgggtggtggcggcgctgaccgcggcgtaccggcagatcgtgcagcgcgcacacgcccgcaacctgcgcgtgtacggggcgacgatcacgccgttcggcggcaacaccgggtacgacgatccgggcgggctgcgcgaacgggcccgggtggcggtcaacggggtgatccgcggcgggatcttcgactcgcacgtcgacttcgccgccgcggtcgccgacccggccgcgccgtcccggctgcatccggcctacgacgtcggcgaccacctgcacctgaacccggcgggatacgcggcgctggccgccgccatcccccgccggctgttctgaggcgcccggccgggctcgggacgggcccggccggcaccggtcagacgcggcggctgaggaccgcggcaacgacgaccgggatcatgcagaccgcctggaccgcggcgtaccagagcgggcagacgccggggatcaggtcgaccccgacgatcgcgatcggcatgatcacggtgagcacgcggatccggtcgagggcgcggggggacccgccggccgccatccggtagaggaccaccgcgacgatcgggagcagggcgccgcgcacccacatgaaggtgttcaccgtgccgccgtgcgcggccacggcgacggtgccggccagcgcgaccgtgctgaggacggtggcgaccttggtggccgtctcgacccgggcggcggtgggctgggcgttcatcgcgatatccatgccgatgaacctacggagcgtgaccggtcgcgaccatccgtctgaccgcccacccgggtgggggcagccccaccctatgccgggtgtcacggtgaccgccctcagatgacccggcggcctgccgactctacgggcgtgccggaccaagtgttcctgctggccaacctggtgatcatggtcgcctacgcggcgatcacggtggccatcgtggtgcccgtccgccgggccggtcagctgcgcagcaacaagctggccaccgcgaccgcactgatcttcttcagctgcgcggtggggcacggtctgcacgcgctgggcggcatcctggccctggcgcacggctcgccgcacccggcccggcaccccggcttcagcgccctctgggacgccttcaccgccggggtggcctgttactactggagcctgcgccgcagttacggggtgttgctgagcaaaggcgcgatctatctcgacccgtggagccggcaccggctggacgaggccggcgcccgcgagcgggcggcccgggacgtggccgaggcgcaccgggccacgctggccaccgtggtcgagcacagcgacgacgcgatcgtcggactcgacccggacggcctgatcaccgcgtggaaccacggcgccgagcggattctcggctacgccgccgaggaggtgctgggccggccgatcacgatgatcgccgacgacgcgacgggtgccgcggaacagcgcgaggtgatggcgctgatccggggcggcgcgcgcgggcacagctacgaggcacggcggctgcgcaaggacggcaccccggtcgacgtggcgctgaccatcaccgcgatccgcgaccagaccggcacgatcaccggcttctccacggtggcccgggacatcaccgccgccaaggagagcgctgagcggcagcgggccgtgcaggagcgcacccagcaggcgcagcggatggagagcctgggcaatctggccggcggggtggcgcacgacttcaacaacatcctggcgatcatcgcgaactacaccgagttcgcgatcgaggagaccaccggaaacccggccgtgcaggccgacctgatccaggtgcgctcggccgcggagcgggccgccaacctgacccggcagctgctcaccttcacccggggcgacgcgatccagccccgggacgtgccgttggacgccgccctggccgaggtgcacgggatgctggagcgcaccatcggcgagcacatccacctggtggtcacgccgccgcgcacgccgctgaccgtgcacgccgacccgggccagctccagcaggtgctgctgaacctggcgatcaacgcgcgggacgcgatgccggagggcggcaccctggtgctcgaggcgaacaccgccgacctggacggcaacgaggtgaacatgcagccgccgctgccggccggccggtatgcccggctgctgatcagcgacaccggcgagggcatgtcgccggaggtggcccagcgggtgttcgagccgttcttcaccaccaagccgcgcggcaagggcaccggtctgggcctggccaccgtgtacggcatcgtcaccgaggccggcgggagcatcaacctgtactccgagccgggggtgggcaccacgttccggatctacctgccgatggtggacgcgccggccgtcgccgggcccgccgatcgcccggacgacccgccgcgcggtgccggccgcaccgtgctggtggtcgaggacgaggtcgcgctgtcacggatcatcacccggatcctgaccggaaacgactatcatgtggtggtcgcctcagacggccggcaggccctggagctggccgcccagcacccgtgcgacgtgctgctgaccgacgtgatcatgccggggatgtccggtccgcggctggccgagctgctcaccgcacggcatccggggctgccggtggtctacatgtccgggtacagcaacggtctgctgggcagcacccacgtgctcgacgaggacatcgcgttcatcgagaaaccgttcaccgccgccgacctgttgcacaagctcggcgccgcccttgacatccatcagcacgtatatcgagactgatgtttgcgtaaacaacagaagggtcacggatgcggatcctgaccgcggcgctgccggggcggcaggcgcggcgcggtttcaactgcgccggggcgggcatgcgcggcgcatgcccgccctgaccgacacgccgccgctgcccgcccacctgcaggttgaggtcacctcggcgtgcaacctgcgctgcaccatgtgcctggtccggtaccggccgccggtgaacaagctggccggcgcgatgcgcccggagctgttccacgccctggtagccgagctcccactgcggcagctgaccctgcaggggctcggcgagccgctgctctccccgtacctgcccgagatgatcgcgagcgcggtgcggcgcggcgtccgggtcgggttcaacaccaacggcacgctgctcagccggcgccgggccgacgagctggtggccagccgggtggactggctgcacgtgtcgctggacggcgccggcccggcggtgtacgaggcgatccgcgagggcgcgcacttcgacacggtgatcgccaacctggccgggctggtcgcggcgaaacgggccgcgggcagcgccaccccgtggatccgggtggtgttcgtcgcgatgcgggacaacgtggccgagctgccggccctggtccggctgctcgccgggatcggcgtgaacgagctccgcgtgcagaacctgtcgcacagtttcgacgacgcgacggccgactacaccgagatccgggacttcaccgcggcccaggcgctgtggaccggggccgacctggaccgggcccgggccgccttcgccgaggcgtccgccgccgcccgggacagcgacctgaacctgcgcctgccgcacctggacgagcgggaggcgacgggtggcggctgcacctggccgtgggatgccgcgtacgtcaccagtaccggggtggtccagccgtgctgcatggtgatgggtgacgaccgggtcagcctcggcgacctgaacacggcgagcttcaccgagatctggcacggcgagccgtaccgcgacttccggcggcggttgaacagcgcggagccaccggacgtgtgccgagggtgctcgctctaccgccacaccttctgaccttctcttcgtccatccaggccggtggggagtctgatgcactcttcgtgaacggtttgccggagtgatctcttcacttcgccgtgagttctctttttggcacgcgcacggtccgcgaagaggaccaggatgcggtggtgacgcttttctccagcaaccgtcccaccaccgtggacgagtacaccgagtggaacgccaaggcgctggcccgcgaatcggtcagccgccggtccgccctcaaggcggtcatggccggcgccggcggcatcgccgtcgcccagttcaagctcgccgacgcggccttcgcggccggtggtggcaccgccggcacggccggtgtggtggtctccggccgccacctgtccttcgtccccggccgggacggcatcccgcaggccgccatggcggtcaccgcgcagctggtcagcaagaccggcagcctgccgaagaacctgcgggccttcgtcgaggtcggcattgccccgggccactacggcgcccggcacgaggccgacatccagcacctagtcgggcagtacgcgatcccgggcgggccgatcggcagccagttctacctcaaggcgaagatcaccggcctgcgcccggaccacatctaccactaccgggtgcggctctccgacggcaccgtctccggcgacgcgcacttcaccaccgcgccgggcagcggccaccacagcggccacttcgggctggagccggccaagccgttcaccttcaccgcgttcggtgacgtcggcaccaacaacgcgccggtcgacccggcgtacgcctggggccaggacccggcctcggtcaccgcgaacggcggcgcctggccgaagggcgtcttcgacaacaactactacaacgcggccgacccggtcggcggcgccaccggcaccgatccgaagccggccgtcacccagaccaacctgatggcctcccagcacccggtcttcaccctgctggccggcgacatctgctacgccgacccgtccggctccggcctgccggcggacaacaccaacgccctcgcgggcggagcggcgcccggcacgaacctgtacaacccgtacgtctgggatgtgttcttcaaccagatcgaggcgcaggccgccttcaccccgtggatgttcgccaccggcaaccacgacatggaggcgctgtacagcgagaccgagttcctcggcggcagtgacacgcacggctacgccgggcacctgaagcggctcgacatgcccggcaacggcccgaagacctgcccctcggtgtaccgcttcgtctacggcaacgtcggcgtcatctcggtcgacgccaacgacctgtccgcggagatccagaccaacaccggatactccaagggcgcccagctcacgtggctggaggacaccctcaaggcatggcgcaccgacggcgggctggccgaccggatcgacttcatcgtcgcgttcttccaccactgcgcgtactccaccaccaacaaccacgcctccgacggcgcggtccgctcggcgctcgacccgctgttcagcaagtaccaggtcgacctggtcgtgcagggccacaaccacctgctggagcgcaccgacccgatcaagaacggacgccgcaccaagggcgccccggacggctcgacgatctttccggccaccgacggcgtcacctacatcaccgccggctccggcggccgcccgcgctacccgttccggccggcccccagcgccggcgcccccgcacccaccgggatcactccggagggcgtcgagctgctgcccgagggtcagcgctaccgcggatatcagccggccggcggcgtcaacaccaccgagaacaacaccgagaacatcgtgaacagctactactggtcgacggagggcacggcgatcaacgcgtccggatacccgtccgggacgaaggtgccggagaccgtcgactggtcccaggtccgctacgacgactacgcgttcatcgcggtcgacgtcgtcccggcccggcgcggccagcgcaccacgttcaccatccggacgctggcggacgcgctgccgggcagcggccagccgtacagcgagatcgaccggatcaccctggcccggaccgccggcctcagccggatccgcaccctgcaccacggccactgaccaggtcaaaacccttgcggcggtacgacgttccgcccgcatcccgctccgatgatcctcggcccggcacgcctcgcgcgccgggccgccccacgcgtggcgtcgatcagtaccgatccgccgacgtcgaggacgcagctgctgtgcccacagcggtctgccggcttcccaccatcggattagccggatccgggtgcccccaggacccatcggacatcggcgtcggacgatcgatgacattcggatggccgaacggtcaccattgaagttgatctcgatccacagtggcctggcagccgtgagtgctgatggtgggcaggggctcacctatgcagcagggggatttcatgttcagcaccaagcgttcccggatccgcgctctggccctgaccggtagcctcgccgccgccggcgtcaccatcggcgcggtcaccttcgacgcctcggccgccgagacggccgcacccgcccctagctagctaggcgcccgcggcggctcagctcaaggccgtgccgccactggtcacggcggtgccgaaggacatccggccgccggacgggtcgcagccgatcggggcattcgtggtcaccgccggcacccagaactacacctgcgtggtgccggccggggcgaccaccggcggctacaccggcaactcggtgccggaggcgcagctgctcggcaccggcggccggatccaccacttcgccggcccgagctggcagtcggagcgggacggttccctggtcaccgccaccaagaccgcggcgctgccgccgcgcgccggcgcgatcccggagctgctgctgcaggtgaagacccactccggcagcggcatcctggaccgggccgactacatcaaccggctctacacctcgggcggcgtggccccggccaccggttgcaccgcgggccagacggtcagcgtcccctacaaggccctctacgtcttctgggacgccccggccgcctgaccccgaccggacaccggcccggcggccaccgccgccgggccgatccggtcagacgtcggggcgcccgaactcctcgatgaggaattccggctcctgcccccagaacagcgagatctccgtgacgatctcccgcaggttgcccgcaatctcgggcggcagcggctcgccgttgtcgtcccagcgggggcgggccggcaggcggtacctgatccgatgcgtcccgcgatccacaccgatcatcaacgaatgctcaccgagccggaggagcatgtcctcccgaccggctccggccagcgtcacgccgctctcgacatggagcgccatctgcgacatcaccgaacgtactgtcatgtcggacgcctccggatcacgggaacggatcgatctcattgatcttcgtgatgttcgggttcacttgcaatgccggcttctccctggtgtaccagacacttcccgaccaagcctcatgggtccaggcggtcgcctcgccggaggcgttctgcgcgtaacgctcggacaacctcttccagacatccatcgcctgatcgccgttgaccggtgagccggactcgaacagcttcatgtcgtcgaaccgcttgccgcccggcgtcatttccaaagttagcgaggttgtgccgttgacctgcttctccgcataggcgcgcatcttctcgccaccgggttgcaacccggagtagaagttcgcgccatggagcggactgcgcacgtcagcgttctcgacctcatgcatcagaccgcggaaagccgtcctctggccgcggacgacggtcttctcggcgagggttctggcgccggccttctccatcatcttcgcggccttgcggagcagcgtggcgatctcgcgctcgatcagcgccatcgcctcgtggatgagcttccgcaccgcgacccgggtcagcgcgatccatcccggaatctccgcgagcgtcgcccccgcggtcacggtcgccgtcgcgaccgcctgccccacctcgacggccagcgcggtcaactgcgcgatgaacgccatcttcagggcgagcgtcaccccggccatcgcgaccagcgcgccgccgatcatctccgcggcggtcgccgattcctgcaggtgcctaccggggccgtcgtcgccgttccaccagcgttcgaaagcgtcgacgccggcgccctcgttctccagccacacctggcgggcggcggcggtggcctggtcggcgtgcgcccgcatccgggtgccgtggtcgatccacgccttgccggtggcctggagctgatcctcgtcagcctccggccattccagcccgatccagctgagcggctcggtgagctcgtgcggcagcgtcagcgtcatgaccgttacaccccgctcctggcagccgcgggtccggccccggacgacgccggagcggaggtggggccggatgagtacggtgccgtgagcccggttgcggacggggccgggccgggcgatgagacagtgcccggcgcgggggtgaggacgccgggggcgggggccggggcaggggcgggagccgggtgtgccgacgacccgccggtgttttcgccggtgacgccgcccggcgcgttcggtgccggagccggcgtcggggtggtcgggtcggcgccgggcaccggcggggtcgccccgggcaggccgctgaccgcgtacagcgaagaggcggcctcggcgtccgccgccgcgaccgaccgcgcctgcatgaccagcgccgccgccgcgtagccgacctgttcggcgtaggacgccatggcgtccaacgccgtctccgccaccgcccggtaggcgagcgcgaacacgcttgacgtctcgtcggcgccccacgggtgcgcgccgccgaccgccgcttcgagggaggtcacgtcgtcggcgatccggccggcgatcgcggccaggtcgcgccccgcgtcggcgacccggtccgggtcgagccggagccgtccggtcaccacggccggtccgcccgccggctcaggtcgtacaaggcgacggagacttcggcgaaccggcgttccgcggtgtccgacgcctcggccagcgcggccttcagccggtccgggacgaccgtctcggcgtaccgggcggtggccgcctcggcccggtcccgcaccgcgtcctgggccatggtgaacgcggtgaccagcgcgtcgcgcagttcaccgagcggcaggtggacgacccgcgggtcgaggtacagctcggcgatccggccgtcgccgccgagttcgagccagacccggccgtcagccgcttcgccgaccgccggaggcgcgctgtacgagccgcccaccgaaggcccgccgtacgagccccccgccggaggcgcgctgtacgagccgcccaccgaaggcccgccgtacgagccccccgccggaggcgcgctgtacgagccgcccaccgaaggcccgctgtacgaaccgcccgcgggccccccgccgtacgagccgcccgccgctccgccgtacgagttgtcgcccatgacgcccctccacttcggccgtcccggggaacgccctgtgaagcgacgctcaccccctgtgctgccgaatacagcgcggggagtgaaccagttcaatgaaaaaggccccgcggaccggaacggtccgcggggctttccccgacgggtgggttactcggcggcgtccgggccgctcgtcaggtccatgagctgctgggtgacgtggttggtcagcgcctgttggtagccggaggcgagctggcccagcttgtcgatctcctcgaccagggcggcccgcttctccacgaggctgtccatcgcctcggcgtggttgcgtcgggcgtcgctctcgatggtgccggccttcatctgcgcctcggcggtgagctgctcggccttggcacgggcaccctccatcaccgactcggactcgcgctgcgcgtcacgcatgtgctcgtcggcggtgcgctgggccatcatcagcacccgggcgttgcggtcgtcgtcgccgatggtcggcatcgcgccggacggggcggcgctgcgggcgcgctcgagctgcgactgcacgttgcgggcgttctgctcggcccgggcccgggcctcctgcagccgctccagttgggcctgcaggtcggcgaactcgttggtgatgaccatggtggcggccgggttgccgccgccgcgctgggcctggttgcgcagcgcgttgttctcctcgagcaggcggatcagctcctgctcgacctcgtccaggaacgcgtcgacctcttcctcgtcgtaaccccgcttgccgatcggcggcttcttgaaggccacgttgtggatatcagctggggtgagcggcatcgcattcctcggttcccgtcggcggacgtggtgcggcccgaaatcctacgcaacagcggcacgttaccgcccgtgggcatgatcacgcggcccggaagtcgctgaccaggcttgatgtgagcaggcgcacgcccgggtcccggcgtgcaagtcacggatagtaccggcccgggccgtccggcgcacgagtcgatcatcgaaaatccaggtcaacccgggcggagcgggcggcacgcggcattgcggaggtacatgcgaatcttcgatgcccgcgaaatcgggcatcgaccacccgcagcctccggcgacccgcggccggccactcccggacccgacaacgcgccaccgccggcccacccgccgacccgacaacgcgccaccgccggcccacccgccgacccggcgacccggcgacccggcgacccggcgacccggcgacccgccggagccggccacccggcgacccgccaccgccgcccaccttcagaccttggcgacccggatcaccccggcccggtgctggagcaccccggtgatcactccacccaccaggacggccgcgcaggacgccagcagcgcgaccggggacagcccgggcagcagggtgaggatcagcaccaacggcacaccgaggccgggccagagcagggcggcccggcgccggccggagaggacggcctggatcaccgcggcgctgagcaggtatccggccagtccggcgccgagcaccgcccgggtgccggccggcaggtggtcgtcggcgccgtgccggatggcgtgttccagcccgaccgcgacggccgccaggctgatcgcgaccggcaggtgggcgtagacgtagaagtcgtgcaccccgcgccgggtgcgttcgccgccctcctggacgaggcggcgtttcgcggcgccgccggagaggtcgaagtacgaccaccagagcgcggccgcggcgaggaacccgcaggcggcggcgaccaccactggggcggcccaccggccgtcgtgcaggccgaccacggcggcggccaccgactcgccgagcaccaggatgacgaagagcccgaagcggtcgggcaggtgttccatgtgcagcggaggcgcgtccggcacccgggtggccagggtggggccgagcaggtcgaccaggacgccggcggcccacagggcgtagcgcgccgggccgggcacggccagtgacaccgcccagcaggcggcgcccgcggcgtgaccccacaggtacggccggatcccggcccgggcgtccggcagattccaccagacccgcaggtagccgagcaccagcatgaggcgcagcagcacgtagccggcggcgaaccagcgggcgtgggcgccgatcgcctgttcggcggcggccgccatggcgatcacgccggccatcccggtcagggtgagcagccggaagatcgcgtcgtcggtgtcgaaccggttggcgtacagcgtggtgctggcccaggcccaccagccggccaccaggacggccacgaaccggaatccgccactgagggtctggtgctcggcgagcaggtcggcgcagcggccgacgaacagcacgaaggccaggtcgaagaagagttcgaggcgggtggccgagcggttcgcggcacggttgacgtccggcgggcgaacgaggtcgcgttcctcctcgtcctcacggttcagcctggcctggtcggtcgtgccgctgttgtccacccggtgcgccttaccccgtacgcaatgatcgaaatcaacgccgcaaccatcaggaaagcgcttgcctaggcgcgatcgaggtggtccgccccggcggagagctgaaacagcgcgtgaacacccggcgaactctataagtgccctatggatggtggccgctgagcgggtaaacgccgtttcgtgacccagacaaccgtggtcctcatcctcgtggtcatcaccgccctcggattcgacttcaccaacggcttccacgacacggccaacgcgatggcgacctcgatcgccaccggcgcgctgcgtcccagggtggctgtgctcctgtccgccgtgctcaacctggtcggcgcgttcctctcggtgcaggtcgcgctcaccgtcaccaacgcggtggtcagaatccagaacagcgacggcaccccgaaggcggatctgctcgccgacggcggccaggccctgctgctgatcgtgctggccggcctggtcggcggcatcgtgtggaatctgctgacctggctgctcggcctgccgtccagctcgtcgcacgcgctcttcggcggcctgatcggcgccgcggtggccggcctcggctggagcggggtcaagtggaccggcgacggcaccaaactggacggcgtgctcggcaaggtgatcctgccggcgatcatgtccccggtgatcgccggtgcggtcgccgcggtgggcacctggatcatctaccggatcaccgtcggggtggcgcagcgcttcaccgagaacggcttccgctggggccagatcggttcggcctcactggtctcgctcgcgcacggcaccaacgacgcgcagaagacgatgggggtcatcacgctcgccctgatcgcctccggcgagtggaccgacaccgggaacatcccgctctgggtcaaggtcgcgtgtgcgctggccatcgccctcggcacctacctgggcggctggcgggtcatccggaccctcggcaaggggctggtcgagatcacctcgccgcagggcatggcggccgagaccgcctcggccgcggtgatcctctcctccagccatctcgggttcgcgctgtccaccacgcacgtggcgaccggctcgatcctgggctccggggtcggcaagccgggcgcgcgggtgcgctgggcggtggccggccggatggtggccgcctggtcgatcacgctgcccgcggcggccctggtcggcgcggtcatgtggtggctcggcgacctggtcggcggcctcggcggcgcgctgctgatcttcgcggtcctggtcgcactctccgtgttcatgtatctccggtcgcgccgcgaaccggtcgaccagcacaacgtcaacgacgagtgggacaccccggccgcccggccgcgggagaccgccggcgcggcgagctgaggggacggacaccgtgcacaatctgaccctggccttcgagggcgcctggaaggtgctgctcgccggcctcattctgggcgccgggctgccggccgtcttcgccctgggcatccggtcgctcgcctacggcgcgggcggcgacgccgaggtgcacgcggccggcgggagcgggccgaaaccgcaccggctcggcacggccggcggatacctggcgttcgccgtggtgctgctcggcatcgcgctcggcatcaccttcatcgtggccaccggcttcggcaaggcgctcagcttcgagcacctctacccgacgatcatcgacaggaagcactgaggcggtcgtgaacgagcaacggtcgaacttcgtcacccgcgccctcgggtggctgcgcgccggctatccggagggtgtgccacgccgggactacgtggtgctgctggggctgctgcgccgcaagctctccgaggacgaggtccgcagaatcgcccaggagctggccgcgcaggcacaacccggggacgggccgatcaccggcgccgacatcgaggagatgatcagccagacgatgctgcaggaggccaccccggccgacgtcgtccgggtgtcggcgcacctcgcggccggcggctggccgctggcggatcccccaccggccgactgagcagaggccggctgagcttcgcggggtgctccacggcgtaccggcatgggcgatcgccctgcttcgggcagacctggctgccgccgtgacgcttcacccggtcggcgaccgtcgggcccgcgtgattcccgtctcctgggcccctgccaccgcgaacgtcgtcactagggaagaatccgtgccggatcttgtgacgccagccggcgacagaaaggaggactgacgtgacgctcacccagcatgctccctcggtccgcacacagcccgggccgaccgacaaccaggccgtgctgatcgtccacggccgggaccgcaccggaatcgtcgccgcgatcagcgcggtcctcggcaagcacgacgccaacatcgtgtccctggaccagtattccgacaatccgcacgggggcgccttcttccagcgcaccgtcttcgccctggaccatctgaaggcccggctcccccaggtcgaggccgacctgcaggcgaaactcgccgagggtttcgacctggagtacacactgcgcgacctgtccgtcccgaaacgcgtcgcgatcttcgcctcgaaggatgaccactgcctgctcgacctgctctggcgacaccgccgcggcgagctcccgatcaccgtgtcgatggtcatctcgaaccacgccgacaccgccaacgaggtccgcttcttcggcgtcccgttcttccacgtgccgtccgccggcccggacaaatccgcggccgaggcccagcacctgcagctcctgcagggcaacgtcgacttcatcgtgctggcccgctacatgcagatcctgtccgggaccttcatcgagcgcgtcggcgtcccgatcatcaacatccaccacagcttcctgccgtccttcatcggcgccggcccctacgccaaggccaagcagcgcggcgtgaagctggtcggggcgaccgcccactacgtcaccgaggatctggacgaggggccgatcatcgagcaggacgtgatccgggtctcgcacgccgacacggtggccgatctgcagcgccggggcgcggatgtggagcgggcggtgctctcccgggcggtccggtggcacagtgaggaccgggtcatccggcacgagaaccacacgatcgtcttcgcttagcacccgatcgcggtcgtacgagcggggtcgcggcccggcctccgctcaccggggtgccgggcctcgcctgccgggcggcatccgctccgctcgcggcccgacacgccacccaccgcaggcggcggggcgcggttgctcgccaggccacgcccgctcgggtcatggccctgtcgtcgcccggggcaggcaccgggtcgcggccgactgaaccgggtaccgcccggacgtcaggcgggctggatggcggggaccgagatccagtcggtgtacttgccggtgcggtcgtcgccggaggactggccgcgcaggcggcgctggatccacggaaggacgtgttcgcggtagtagcgggcctcggcgagcaggccgccgcgagcgccctggccgggatcgatgacgtgggccggggtggggtggccgagggcggtgaggacggcgccggctacccggcggtggccgttggcgttgaggtggaggcggtcggcggaccagtagccgggcttctggatctcccggtcgtggaacatgtcgacgaaggtgaggttctcgaagcggccggcgaacggcgcgacggcggcggtcagcgcctcggccttgcggcgcatcgaggcgccgaacggcaggtggtgggacgggtcggcgccggagagcagcaggacgtggatgccgttgtcgaggcagcggcggatcgcgttctcggtcatcgcgaccagggtggtcatgtcactgccgggacgcatcatgtcgttgccgccaccgttgagcgacagcagggtcggtttcggatcgagggcgagcgcggcgtccagctggtcggtgacgatcggctgcaggaggcggccgcggatggccaggttcgcgtaccggatcggctcgccgagcccggcggcgaggccggcggcgaccaggtcggcccacccccgttcgctgccgtccggctgggtgtcgcccatgccctcggtgaagctgtccccgatcgcgacgtaccgcatccccgcactcccgccgtccgcaccccagttgatcagccccagcgtaaccagcgccgatccgcgcctcgcaggctcgcgccgaccgggtgatcaacgactcgccggggcgccgcggtcccgcaccacctcacgatcgaggactcgccgggaggcgtgcagtcaggtggacccccatcagccggtgccggccttctccggccgcacccctggacaaaacccgcttttccggtacgtcatgagccgtcccggcctgccccgcccacccctttctggtacgaggtggaacgtgaccgcaaccctggattcgcagcgctactgcccgcctcctcccgtgacccacggtgaccgcatcgcgtggtgggacgtgacggtcgccgaggtgcccggctaccgcccactcaccctggacctgttccgccccaccgccgtcggccacccgctcccgctgatcgtctggatccacggtggtggctggctgttcggcggcaacaaggacgccgcgcacgggcggatcgccgaccgaatcctggcggccggtttcgcggtcgcccgggtcacctaccgcctcagcgccgaggcgcggttcccggcccagctgcacgacgtcaaggcggccgtccgctggttgcgccgcaacgccgccgggctcggcctggacccgtcccggttcggcgtctggggcgagtcggccggcggccacctggccgcgctcatcgcgctgaccggcgacgacccggacccggcgctgaccggccgcagcggcgtgccgggcgtctccgacgcggtgcagtccgcggtgctctggtacgcgccgagcaacctgctcagcatggcggcgcagaaccatccggagggccggccggaccacgacgcgcccggctcgccggagagccggctggtcggcggcccggtgcaggagctgccggccgagtcggcggcggccagcccggtcacctacgtcaccggggacgcgccaccgatgctgctgctgcacggggccgacgaccggacggtgccggccgggcagagcgaggagctgcacgaccgactggccgccctgtccgcgccggtctgcctgcggctgatcccgggcgccggccaccgcttcaccggggtggacctggatcccctgatcagcggctcgctgcagcacttcacggccacgctctcgtaaggcctggttgccggccgggagcgacttcggggcaggtcgggtcgggagtcaccgcggcatcacccggcgctctacggtggtgactccccgtaccggcaagcgaaggattttctcgtgaacctgcgccgttccgtctgtctcgccgtctcggccgccgccgccaccgtgaccctgctgtcgatgtcgggcgccgcgcacgcggcgtccgcgcagaccgtgcagaggtccaaaccggccgccacgaaggacaccgaccgggacggcatgccggaccggtgggagatcgcgaacgggctgaacccgaagaagaacgacgcccgcgccgaccgggaccgcgacggcctgagcaaccgggccgaataccgggcggggacgaacccgcgcaccgcggacaccgaccgggacggcatgccggacggctgggaggtcaccaacggcctcgacccgcgcgccgacgacgccgacgacgacgccgactccgacggtctgaccaacacccaggagtacgacctcgacgacgacccgcagtccgaggacagcgacgacaacggcgtgctcgacggcgacgaggacgccgaccgggacgggctcaccaacgcgcaggagtacacgctgcccggctacgaccccaccgacgcggacagcgacggcaacggggtgtccgacggcgacgaggacctcgacgacgacgggctgaccaacgcgcaggagttccagctcggcgacgacccgcaggccgccgacagcgacgacgacggcgtgctcgacggcgacgaggaccacgacggcgacggcaccagtgacctcgacgagctgaccgacggctccgacccgctcggcggcgacgacagcggctccccggacgacaccaccgacccggccggcccgggcgacgacgccccggcgaactgaaccggtcacgcggccgggtccaccctgatccggccgcgccccacccgggctgcgcggctgggcctggcgcacccgcaggaggcggccacgctgctgcccgagacgctggcccggcgggccgacgcggcgatccgcgcccggctcgacaacgcgtcgtaccacctgcaggacggtcacctcgtcgccggaacggccggcgccgcccaggccgcgagcaggcgcagcgcggtctccgacggcgaacccgcctcgaccgtgtgcgcgaccagcgcctgacccgggtcgtccggcaggcgcaacgcctcgaaacccagctccaggcggcccacgacggggtggaggtagacgtacgccccatgggtcttgtccttcagaccgtgctccgcccaggccgcccggaactcacggctcgccgcacccaactcgtcgaccagcgcccgggtacgcgggtcgcccgggtgccgtgccgcgtcgagccgtagatagccggcgacatcccgcaccttcgccggccagtccgcgtagagccggcggatcccctcgtcgagcaccaccagccgggccatgttccgcacccgcgggtccaccgcgccgaagtcggtgagcagcgcggaggccatcgggttccaggcgagcacgtcggcgttgcgcccgatcacgtaggccggcacgtcgccgaccgcgtgcagcagccgcagcaggccgggccgcacccgctgcccgcccgcgccgccgcccgccgggaacgggcgggccaaccggtacagatgcgcccgctcgaccgggtcgaggcccaacgcccgggccaccgcgtccagcaccgactcggagaagtgcagggtgcgcccctgctccagccgcacatagtggtcgacgctgaccccggccagccgcgccagctcctcgcgccgcaaccccggcacccgccgctgcccgtgactggccaggcccagctcgcccgggtcgagccgggcccgccgggaacgcaggaagtcaccgagctcggcccgccggtccagggtcatgcccccagtatccccggctgctaccggcgctgcctggtcacgccgtgccctggcagcgccgccaccggtcgcgcagagtcggcggcatgagaacgcgagaactcggcaccaccggaatggagctgtccaccaccggactgggcgcgtgggtgatgggtggcgccggctggcagtacgcgtggggcccgcaggacgacgccgactcgatcgccaccgtgcacgccgccgtggcggccggggtgaactggatcgacaccgccgccgcgtacgggcacgggcattccgaggaggtggtcggccgcgcggtcgccgcgctgccgccggccgaccgcccgtacctgttcaccaagaccgggctggtctgggacgacccggcccgccgggacaccccgccgcgccggctgatgaccgccgcctcggtgcgccgggaactggaggcgtcgctgcgccggctgcgcaccgaccacatcgacctgtaccaggtgcactggccgggcgacgggcggctgctcagctggggcccgccggacggggccgcgccggtcggcgcgaccgaactggaggagtactggcagaccatggccgacctgcgcaccgagggcaaggtgcgggcgatcggactgtccaatcatggcgtcgccgagctggaccgggccgcgagggtggcacccgtcgacgcgatccagccgccgttctcggcgctggtccgcgagcccgccgaccagatcgcctggagcgcggcgcacggcaccggggtgatcgtctaccagccgatgcactccggtctgctgaccggcgccgtcgacgcgcggcgggtggccgccctgccggccgacgactggcggcgcgggcatcccgacttcaccaccggcctggaccgcaacctgcgggtggtggacgcgctgcgcaccgtcgcggaccggcaccgggtgccggtcgccgccgtcgcggtggcctggacgctggcctggccgggcgtcaccggcgcgatcgtcggtgcccgccgccccgggcagatcgccggctggcaacccggcgcggacctcaccctgaccgggcgggacctggacgaggtcgccgccgccatcaccgcggccggcgtgggcagcgggccggcccggcccgggactactgtcggaccgtgactgacctctttgtcgaggagctcggctcgggcccgctgctcggctactcccacggcatcttcatgagtacccgcggcgaggacgaggccggcctgctcgactggtcccggatcaccgggtcgcgccggatcgtccgctaccaccagcccggccacggccggtcgcccggcgtgcccgacccggagcgctacacctggccgcggctcgccgacgacctgctggcgatcgccgacgaggtcagcccggagcagccggtggactgggccggatcctcgatgggcgccggggcgctgctctgggcggcatcccggcggccggaccgcttccgccggctggtgctgatgatcccgccgaccgcccgggacacccgggagaccgcacggcaggcctaccgctccggcgcggccggggtgcaagccaggggcaaacagtcctgggtggagatcatgcgcggcttccctgcctcgcagatcttcgccgagctccccggctggcagttcgacgcggacgtgccggaggggctgctgccggccgtgatgcgcggggcggcgctcaccgacctgccgtccgacgacgagctgcgccgggtcacccacccggtgctgatcctcgcctgggagggcgacccggtccacccgctcacctccgccgagctgctcgcccgggtactgcccgacgcccggctgcacgtctccgccaccgcggccgacgtccgcacctggcccgcccggatcgacgggttcctcggccgatgacggcggagggcgccgtcccggacggcgcggcggtgcgcttccgggacccggcgatccggctgccggagctggccgccgacgagatcgacgtggtgtgcccgcactgcgggtgccgcgccgtggtcagcgccgaccccgtccagggcgccgtcgcgatgcactcgccgcgacggttcgtctgcacccgctgcgtcaccgtcgcgcagtggccgccgaaggtcggggtctcccgctggggtgggccgatcgatccgtacttccacctgccgctgtggttccaggcgcgatgctgcggcggacgcacgctgtgggccttcaacgaggcacatctcaccctgctggccgactacgtcggggcgaaactgcgggaacgccacccgcgggagcccggcctgacgatggtggcccggttgccggggtggttgaaagcggcggacaaccgcaccgaggtgctccggacgatcgcccgcctgcgccaccggccgacgcgctagtgactgccctggctcggtgaggtgccggcggcgatcaggtcggggacggtgaccatccggaagccgcgcttgcgcaggccgtcgaacatggcggccaggccgtggacggtcaccaggcgtttgtcgtcgccctcgtcgtgggccaggatgatcgacccggggcggaccgagtcgacgatgtcccgggcctggcccatcgggtcgtcgtggaacagctgctcgcgcatcgccttggaccagagcaccacgtcgtagccgagttggtcggcggccagcatggtggagccgccgatgtgcccgaacggcggccgcagcagggtcacctggcggtcgaagtgccggcggatctcctgctcggtgcgctgcaggttgcgggtgaccgcgcccaggtccagggtggccaggtcgtcgtgcgcccaggtgtggttgccgatcgcgtgccggtccatccggccgcggaccaggtcggcgtggcgctccaggcggctgccgaccatgaagaaggtggccggcacgcccgcggcgtccagcgcgtcgaggaccatcggcgtccagtgcggggccggcccgtcgtcgaaggtgaacgcgaccagtggctcggaggtgtcgacgaagtagcggaccgcgacacccggctggtgcaggccgtccagctggtcggcggccgcggcgtagccgcccagcaccggcgggcggtcccagcccagccagtgcgggatctcccgggccccggccgcgccgacggccaccccggcgaggccggccaggccggtgcgcagcagggcgcggcggctcagcatcgcaccgaaccgcacccgcgaagcggcaccgccatgctgacacccccgttgacccggcatggaaagtcaccggattctgactgacgctgtcaaggtgatcgggtggaatcttccccgcataaggattctcccggtacgaagtggacaccttgagtcgccgaactcactccccggggccagcgcgtgggacacccgcccggccggaggacgcgggatcgggaacccgccggtagcctgtccggcatgtacccctcgccgcacgtccgggtgtcggactccgaccgggaggcggtcgtcgcccggctcagcacggcgaccgccgagggccgactcaccatcgaggagttcagcgagcgctcccggtccgcgtatgccgcccgcacctggggcgagctgtcccgggtcctctacgacctgcccggcgacgagctcgtggcgacaccggccgcggccgccgccgggagccggctgccgctgctcgccctgatcgccggggcgctgccgctgccgctggcgctctgcgcccaggtggtgctgcccgccccgatctgcgcggtcaccgcggtggtgctgggcatcatggcgctgcgcggcccggcggacacggtgcgacacggccgccggatggcgatcggcgggatcgcgctgggcgggctcggcgtcctggccatcgtcacgggcatcgcgcagttcctcttcgggggctccctcgacgcctagcgatcggccgggcgcggcccgggttgacgtttcccgttacgcgaccagttcccgcaggcgcgccatcagcagggccgcgacgccgcgcacgtcccggatccgccggtcggagccgatccgggcggggtacgcgttgcgttccatcccgtcgaggatgtcccgggcggcctggtaggggcggcgcggatcggtggggaacaccatggcgacgaacagggtggtctcggcgcgcagctcgtgggcgaaggccttcgccgcggcccggtcggcggccggcgaccggctgtcggccacgtgcaccaggtgcgcctcgggccgcagtcgcagggtgggcaggaaggcgcgggccaccaccggcgtcccgtcgggcgcacagtggatgacggcatcgacctgaccccagcggtcgagcacggcccgcggcagcgcctcgatgccggtcggggccgggccggggctgagcaggtgggtggagagcaacagcggggcgaccacctgccgggcggtttcgcgcagctcggccgggtcggtgtcgaccgcggccacccgggcgccgcgccgggccgcttcgagggccacggcccgcccgatcgcgtcgccggcaccggtgaccaccagggttctgcccgccactctcacccgatcactcccctctatgcggtgactaagatcacgctactgcgcggcgggcgaagctggcaacgccacgacggggcgaccggatcttcccgctttcggccgtccggaccgggccggccccgtaccccgcccacgtccccacgccgagcacctggaccaggccggcagtccggcgccgggcaggggcgggatcggacaccgcgtacctgaagccggggtccgggatggcatgctgcggcgatgaggttgtcgcagcgcgccctgtcggccgagccgttccacgcgatggcgttcgggcggcgcgccggtgagctggaggcggccgggcacgacgtggtccggctcggcctcggcgaaccggacttcggcgcgccgcccgcggtccgcgaggcgatgcgtcgggtgatggacgggcggccgctgccgtacaccccggccttcgggttgccggcgctgcgcgcggcgatcgccgggttctaccgcgagcggcacggggtgcaggtcgatccggcccggatcgcggtcacccccggagcgtccggagcgctgctgctggtcgcggccgcgaccaccgacccgggcgacgaggtgatcgtggccgacccgtcatacccgtgcaaccgccagctggtggagacgttcggcggcaccgtggtcaccgccgccaccaccccggagtcgcgctatcagctggacaccgccgcggtcgacgcggtctggagcgagcggacccgggcggtgatggtggccagcccggccaacccgaccgggacgtccctcccgttcgccgacctggtcgaggtctgcgcccgggcccgggcgcgggacgcctggcgcatcgtcgacgagatctacctggacctggccgacccggccgcggacgggacgccgccgcgcacgatcctgtccgccgacccggacgctctggtgatcaacagtttctccaagtacttcgggatgaccggctggcggctcggctggtgcgtgctgcccgaggcgctcgtgccggcggccgaacggctggcgatgaactacttcctgtgcgcctccaccccggcccagatcgcggcgttggagtgcttcacccccgagtccctggcggtgtgcgagcagcggcggcgggagttgctggcccggcgggccatcgcgctggaggggctggccgggatcgggctgccggtgccggtgccgccggacggggccttctacgtgtatttcgacgtcagcggcaccgggctgggggcgtgggagttctgccgccgggccctcgaggaagcgttcgtgtcggtgaccccgggccgggacttcgcagtggccaccgcggagagccacgtccggctctcctacgcggcgtcccgggaggccctgcgcgagggcctggcccggctcagtcggtttgttcagcaacttcggcgggaatcggctccgggtcgctgagctgctcgcgcagatagttccagatcaccgagacgatcgcggcgaccgggacggcgagcaggctgccgacgatcccggccaggttgccgcccagggtcacggcgagcagcaccacggccgcgtgcaggcccagcccgcggctctggatcatcggctggaagacgttgccctccagctgctgcaccagcaggatgatgccgagcacgatcagcgcctttacccagccgttgaagaccagcgcgatcagcaccgcgaccaggccggcgaagaccgcgccgacgatcgggacgaacgcggtgacgaaggtgagcacggccagcggcagcaccagcggcaccccgacgatccacaggccgagcccgatgaagaccgcgtcgagcagcccgacgaacgcctgcgagcggacgaacgcgctgagcgtgttccagctgcgcccggcgatcgccgggacgtcgtcgccgagccggcccggcagctgacgggacaaccagggcaggaaccgtgggccgtccttgaggaagaagaacatcaggaacagcgcgaggatcgtggtgaccaggccgttcacgatcgtgctcaccccggccagggtggcgttcgcgatgctgccgacgctggcctgcagcttgtcgacggcactgttgagaccgctgttgacctggtcgtcgctgatccgcagcggcgggccggacgcccagtcacggaccgtctggatgccgtcgaccacaccctggcccagcttgccgctctgcgccgagaccggcaccgcgatcagcaccacgatgccggcgaccagggccaggaacaggatcgtgaccagcgacgcggccagcgccggcggccacccccggccgcgcagccagcgcaccggcggccaggtcagggtggtcagcagcagggccaccaccagcggccagagcaccgaccaggccatcccgagcagctccaggaacacgtacaggagcagcaggatcagcagggtctgcgcggagacccgggcggcgtcacgcatcgccgcccgggtcttgctggtgctcaaggtggacgccatgttgatcaccttacggtgaaccacgtccgcgggatttcttccatgcggcgtgggtcaggtctttcgccgccgtacccgcgccgtaccggtcggcggcggcatcggtcggcagtcgggcgcggccccgccggatccaggtcgccgacctcgaccaccggctgatttcgccggtccacttgtgcgccctgttacggctccgtaaattccgtagcacacggagtcgtggccaccacccctggtgacgaccccatggtcctggactcgtcccggcgtgacccgccgggatggtccgcaggaatgcccgggaggcattgcgtgacgttctaccgccaggtcggcagcattccgccgaagcggcacacccagcaccggcggcccgacggcgggctctacgccgaggagctggtcggcgaggaggggttctcctccgactccgcactgctctaccaccggggcatcccgtcggcgatcgtcgacgcgcgcccgtggcagctgcccgaccagagcctgaccccgaacaccccgctcgtcccccggcacctgcgcctgcacgacctggagtacaaggacgccgacccggtcaccggccggcggctggtcctcggcaacgccgacgtgcggatcacctacgcggtgtccagcgaggcgtcgccgtactacaagaacgccatcggcgacgagtgcgtgtacgtggagcggggcagcgccaccgtcgagacggtgttcggcgcgctcaccgtcgggcgcggcgactacgtgatcattccgcgcaccacggtgcaccggtgggtgccggacggcggcgagccgctgcgtacgtacgccatcgaggccagctcgcacatcgcgccgcccgcgcgctacctgagccggtacggccagttcctggaacacgcgccgtactgcgagcgcgacctgcgcggcccggtcgagccgatgctcgccgaaggcaccgacgtcgaggtctttgtcaagcaccgcggcggcggcagcatccacgtcgtgcccgagcacccgttcgacgtggtcggctgggacggctgcctctacccgtacgccttcaacatcgccgacttcgagccgatcaccggccgggtccaccagccgccgccggtgcaccaggtcttcgccgggcagaacttcgtgatctgcaacttcgtcccgcgcaaggtcgactatcacccgctggccgtcccggtgccgtactaccactcgaacgtcgactcggacgaggtgatgttctacgtcgacggcgactacgaggcccgcaagggctccggcatcggcaagggctcgatctcactgcacccgggtggtcactcgcacgggccgcagccgggcgcggtggaacgctccctcggtgcggagttcttcgacgagctggcggtcatggtggacacgttccggccactcgacctcggcgaggcggggttggcctcggacgacggccgctacgcgtggtcctggtccggccgcggtccgtccgcatgaccgcgacccccgcgccgcccccgtcgcgggccgccgccgacgtccctgcgcaccccaccggcatcccgccgcactccggtgccgaccttcctccgcactccggcgcccgtcacccggaccgctccggcgagcgcgatcctgagtcggttttcgatcctttcgcccttttcgcccggttctttgacgatgccgcgctgttcccgcccggcaacgcaccgatggcggcggccgtcccggccttcctggatcgcctcgccacgccgcacgccccgctggtcgggccgttcatcgcgcccgcggcccgcctggccgaggtcgccgcgcacctgcggcccgccggtccgccgctggacatcgccctgatcgccgcccccgccgacctcccggccgccgtcgacaagatcgacaaaacgccaggaatgcgcctggtcgcggtcgaggcgccggtcgcggtcgacgccgcacacacccgatcggcggtacgcgtcatagcggactcgcttccccccggccttccggccgcggtcgaggtgccacgcaccgccgcccgcgacgaggtcctggacgccctggccggcacccgctgccgcgccaaactccgcaccggcggggtccgtgccgacctgttcccgccggtcgaggagctggccgccaccatccgcgcctgcatcacccggtccgtcgcgttcaagtgcaccgccggcctgcaccacgccgtccgccacaccgacccggcgaccggcttcgaccaccacggcttcctcaacgtgctgctggccgccgcccacccggacgccgccgagacccacctggcccgcaccgacgccgcgcggatcgccgccgacctgcgcgcctggtcgcccgccaccgccgtccgggcccgagccgccttcaccggcttcggcacctgcgacctcgctgatcccgtcaacgacctggcccacctcggcctgctcccggagagataccccgcatgacttggctccacctgcccgaagccaccggtttcggcctcaccaacctgccctacggcatcttctccaccccggccggcaccgccgccggctctcccaccgcacccggcgccgcgccacgctagctagctagcggccggccggttcggcggcccccgtgcccggcgcgcggaccggtgtcgcgatcggtgaccacgtgctggatctggccgggctgaccggtgatccggtgcacgcgaccggttcgctgaacgcgttcatggcgcagggcccggacacctgggccgccctgcgctcgatgatcaccacctggctgaccgatccggcccatcaggagcgggtgactccgcacctggtgccccgcgacggggtcaccatgcacctgccgttcgaggtggcggactacgtcgacttctacagttcccgggaccacgccgagaacctgggccgcatgttccgcccgggttcaccggcgctgaccccgaactggacccacctgccgatcggctaccacggccgggccggaacggtgcagctgtccggcaccccggtcacccgcccgcagggccagtcgctggtcgacggcacacccgccctcggcccgtcccgccgcctcgacatcgaagccgaggtcggtttcgtggtgggcaccccgtctccgctgggcaccccggtccccttgtccgacttcccggcccacgtcttcggcgtctgcctggtcaacgactggtccgcccgcgatctgcagtcctgggagtacgttcccctgggcccgttcctcggcaagtcgttcctgacctcgatctcgccgtgggtcgtcccgctggccgccctgtccgccgcccgggtcaaggctcccacccgggacgagcccctgctcccctacctggacgacagcgccgaaccgtggggcctggacctcaccctggaggtccggctgaacggccacgtcatcagccgccccccgttcgccggcatgtactggacccccgcccagcagctcgcccacatgacgatcaacggcgcctccctgcgcaccggcgacctgtacgcctccggcaccatcagcggccccacccgcgaccagcgaggctccctgatcgaactctcctggaacgcctcggacccgctgaccctcccggacggctccacccgctcgttcctcgaggacggcgacgagatcaccatcaccgcgacagccccctcccccgacggctcccgcctctccttcggcaccgtcaccggccgcgtccttcccgcccggtgacccgccgccgacaacccgcagcaccgatcagttcgccgccacgccggtaccgcccacggtcggtaccggcgcccacgatctcgcgccgtcctccggcacggcatcgccgcaccctcgacccgggactgcggcggtatcggacctgaagccggcgcctgtgtctgacgttcgtcggagcgggcacctgttcggccggtgatcggggaccgtttcgtcgccgcctttgtcgcacgatcgggcgttgaaacgattaatggcccggttcccgccgctcctcaacgacggaaaccgggctccccccaggaaagtcacatgggtagaacggtcacgctctcctgcgacacgtgaattcaccagacatttaaatagtcggcggaatcaccttgcatcgatcaggcacatcaaaccgccagaattcttccggcgcaaagcaactcaccccgaaccggcaaaccgacgcgcgcccagcggcaaaccgacgcgtacccagcggcaaaccctggtttgcgcccagcggtaaaccctgaagcgcgcctggcggcaagcccgaccacgcccagcgacaagctcgaagcacatcccggccgagagcgacctccgacggagcgggcgacggacatccaccccatggcactccgccacccgcgccggtcggcagcctcggcccgtcagcggaccagaagcgtgtagttgggggcgacgccggtgcggcaccgataggtgacccagacgtgtttcgcaacgccgtccgcaccgacccggtcgcactcgacatcaggccgtgcgacctggttgaacagggcagtgtagaccgccgtctcggtggcggccgcggtgtagcgcggagtgtaggtgacgatcaggtcgtcaccggcgatcccggaccgggtgccggcgacagtccagacaccggctgtctcgccggcggcgccgatggtcgcggcgcggccgaacgcataagtcccgagaacgtctgtcgtcggacacggcgacgcctgggcggcaccggggacgagaacggccgggatgaggccggcgagcaccatgctacgcatttccgaatccttttcactaatcgccgcgagggtctcccgcgggcatcgagaggccaccggatggttcttcatccagccggcccgcatcaacctttgaatagaacctacaccggaaccccgtccagaaatcgcgccgcgcagagaacaatatgttaagtattaacgtcggttaatatcgaggattccgtcgaccgcaacacgacaaattcgcacagcagacagatcaacaaccgccgcgccgcaggaaaacaacagtcgcaagcaacaaacacacctgccgacaacccggcgtcgcggtagtgggcaggggcggcgacgaacgcgcgacggttcagccccgcagcgcatcgatcacggcagcgacaggcgccggacgggcagcgcttcagccccgcagcgcatcgatcacggcggcgacaggcgccggacgggcggaggcgtggttgacacccgcccacaggttgagggcggaggcgtcaccacgacgggcggcggcggcccggatcggggcggtgaggtggtggatcgccgggtagccgatcggggcgatcgacgagtaggtgtcgacgaagcggttgcgcagggctcgggccggctgcccggtgaaagcccgggtcaccaccgtctcgcgatggtcgccggagagcatggcggcgcgctgggcgggacgggtcccggcctcgtcggacagcacgaacgcggtaccgcactggacggccgccgcaccggcggccagcaacgcggcgacgtcaccaccgccggccgcgatcaccggaatgtcggcggcggtgcgggcgacggccaggacctcggcgaggacgtcgcgcgtggcgcgggtgccggtgtaggtggccgggctgaacgtcgacgcgtggccacccgccgacccgccctgggcgatcagcgcgtccggcccggcggcgaccgcctgccgggcctccgcgccgctggtcacggtgatcaggacggcgcagccggcggaccgcagggcggtgacgacggcggccggtgggatgccgaaggtgaagctgaccagtgggatgcgatggctgacggccaggtcgactttcgccgcgaagtggtcgtcgtcgctcagccgcagcggcgggaggtcgatcccgtagcggtcggcttccggctgtagcgcggcacggtaccgctcaaggggtgccacgtctgcgggtggggacgacgggacgaagaggttcaccccgtacggcacatcggcttttcgtacttcctggacctcggcctcgaccgcttccgggggcttgtagccggcggcgaggaagccgagcgcgccggcgtggccggcggcgatgacgaggcccggggtggagggtccgcccgccatcggggcgacgacgatcggccgcagcagctcgcgcatgccgcccaacctaccgcgccggccagcccgaaggggacgggcgcggaaggagaccgccccgccggtgcacgcaccggcggggccgtcacgatcgagttacttgaccacgaccgtgccgacgatcttgtcggcgatggtctgcttcttctcgtcccagagcgggaacaggaagccgacatagcagatgatgaagtccacgaagtgcgccacgccgcgcaggaacgccttgccggcaccgatgggctggccggtggcggcgtccaccaggcggatgccgagggccttcttgccccagctctggcccttgccgtccaggaagacccggttgtagaacgacaccaccacagcgagcagcaggatgatgaagtacatcgggctgaagtgcgtctgcagggtcaccgggtcgaccgtcggccggaagaacagcgcgacgatggcgaacggcaggatgaccagcatatcgacgaggtacgcgccgacccgcgcgccccagctggcgtaggtcacggccgggccgtatccgggcgccggcgcgccgtagggctgctgaccgccgtacggctgctgcgggatcggctgcccgtaggcctgctgctgaggctggccgtaggggtcgttggggggaggataagacatcgagaatccttaattcaggcccagctcacgccgagccggtgcagttgaaagagccagctcgctgccgccagcagtccggccagccgtcccatccgtcggcgcccggtgggcgaccacggttgcggtgcttccagcacgcccgcggcgcggagcgcgacgagcgggccgacggcgaccgcgagggccgccagaccgaagatcacggggttggcctggagggcggccccgacgtgcccacgcacgagggcgaccgccgccgtggtcaggccacagcccgggcacgggatcccggtgagggtccgcatcgggcagggcgcgccgaggccggtgccgtcggtgaaggcgggccacaccgcggcggccccggcgacgagcacgccgaaaccaccgatccgctcaggaacggagaaggctctcaccggcacacacctcgtgatcaaggaacagcgcaccgatgataagggggccgtcgatacctggcgagccggttaagcaggcaattttccgactcaatcggccattacgcggttgcggccggcttcctttgcccggtacagggcgtgatcggcccgagcgagaagatcgtccagtgcggtgtcgtcgtcacccagtcgagtcagcccgatactgatcgtgaccggcaggggtccggcctgggtcgccaccggttcgccgccgaccgccatccggacccgctcggcgagttccatcgcctcaccttcgtggtcgggaaggacgatcgcgaactcctcgccgccgtagcggccgagtacgtcggagtgccgcagcacggcccggatgcgccgggccacggtgcggatcacctcgtcgccgacgccatgaccgtacgtgtcattgacgctcttgaatttgtcgatgtccagcatcgcggcggccagcggccgtccgttgcgggcggcggcctgcaccagcgctccggcgacggcgtagaagtgccgccggttgtgctgcccggtgagctcgtcggtggtggccagttcctgcacccggctgaacagccgcgcgttgtcgtaggcggtcatcccctgggtggccagcgcggccgcgacctggcggctggtgtcgtccagcgcggcgccgccgagcagcaccgtcccggcgcgcccgtcccggccgtcgaggggcacggcgagcgcgaccgggtcgccggcaagcaggcgttcccgcaggccgccggtgccggccgggtcgagcagggcgggttcggtgaggccgccgacgagcgccacctcgtccggagtgagccggccgccggcgatctctgcgggttccaggacttcgccgtccgggctgaccaggcagctggatccggcgccgagggtgctctgcagggtgccgctgagccggcgcagcagccggtccggttccaggatcgaggtcagttcggcgaggctggcacgcagcgtttcggcgagcgcctgctgctgctgcgcggcctgcacggccaggtgcagctgggcggcccgggcggtttccagggagatcgcgacgtggctgctgaccgcggtgagcacgtcgacgtcgtcgtcggtgaagatgccgcgggcgagccggctgtccaggtagacgacgccgatcagccggcctttgaactgcaccggggcgaccaggatgctgcgcaggccgtgcgccacggcactgcgcgagccgagggcggcgccctgttcggtgccggtgaccacgaccgcctcgccggtctcggcgacccggcggaccagggtggcgccgtattccatggtgtcggtgagctcgcccgcggcgtcccggccggcgaaccggaccggttccccggcctcgtcgagcaggaagaacagtgcccgttcggcgcccaggatgcgcagcgtctcgtcgagcgccacctgggccagctgctgcgggtcgaggacggtggcggccgccgtgctgacctgctgcagggcctccagccgccggttgcggccggttgccgggccacgccgctcggcgaccgtacggcgatgggtgctcgccccctcgtccaccccgaactcggtgcgggtctgccgccgccgctgctcccagccgtagaaggtggccagcgccagcgcggagcgggcctgccggtcggcctcgtggttcaacccgagggcgcgcagcgcccgggcccggatcttgcagatctcgtagtgggccatcggcgcgtccagcgcccgggcggtcttctcggcctcgtcggccagtttgagcccgcgttcctggtcgccgctcatctgcgcgagcgacgcctgggacagccggtaggagagcttgatcagcggtgagccgccggcccgcccgagttcccggatcgcggtgaccgcctcggcgagccgggccggccggtcctcgtcactgctgtaccgcagccggatcagccgggcgtgcgccgcgaacgcgaggatccacttgtgctgcaccatcagatcccgggtgcgcagaccgaggccgcggaactcggccatcacctcgtcgaacgactcgccgatctcaccctgttcgaggagcacggcggcggccgccacgaggatgttggcgtgctgcacccgggtgccggtgccgggtgggatggcgtcgcgcagccgcttcacggcggccgccgcctcgccgaaccggccctggtaggcggggaccatcgcgcccagcatggacagcgacgtgccgtaggtgagcgccgggtcggcgacgccgcgcagcccgcgctcgtactcgcgctcggcgtccgccgggtagccgcgcagcagcagccgcagcccctgcgaggcgtacccgggcagcagctgggccggctcgtaccagcgggcgttgcgggtgatcgccttctcccaggtgctgccgtcgtcgtacccgccgagcagcatcgagcagccgttgatccaatccacgtacgcgatcagcaccgggtcgcccagatcggtggcgatccgcatggcccggcgctggcagcgttgcccggtgctgcggagccggatcagcgaactgacgtaaccgaccagggcgtacacccgggcgtactccgggctggggccgagccggttcaccgcgtacatggcccgcatcccgaggatgccggcttcgcgcaggcgcaggccgatgatggcggcataccctccggcgtccaggacagcggtcagcgcggcgagcacttcgcgccgctggccttcggcccgaccgaaaccgatcttggtacgccggacgacggcacccgcgaacgcataggccagcgtcgacaggatgagcagcagcgggtgccggggcagtggccggcccagctcggtgagcgcgtcccgggccgcctcgagcgcccgggtgtcgtcccagatggtgtgggcgagctcgatccgggtcaggtgcatccgggcccgggccacccggtccggttcgaccgccagcgcccggtccagggtcgcctcggcctgcgggaaccgcccggcccgcaggtaggcctcggccagcgagtgcagcatcgccgcggccggcgcagggtcgccgtcgatcgcctcgaccagatagccgaccgcctcctcgggcgcctggtcggcgagggcgcgcaggccggcggcggccgcggtgcgccgtcggtcggcgatcggcgcggcgtcgccggcccgctggtagtggcgggccaccgcgtacgcgtgcgcctcgtcccgcagctcctcgggaagccgttccagggcggcggcggccgcggcgtgccgctgccgcagctcgtccgggccgagccgctccagcagggtgtcacgcagctgcgggtggacgaacgcgtaccacccgccggcccgcacctcgagcacgtgccgctccagacctgcctccagcgcggtcctctcgccgtcgccgggcagcccctcgggccggaaccggacgccggccaccgcggccgtggtgagcacgtcgagaaccggctcggacagcccggccaggcgggcggcaagcaggtcccggatcccggacgcggacggcagcgcgtccgcgccgacggtgtccaggtgccaggtgccccagagcgggccgagcagcccggcgtcgagcaaccgcatcaggtagctgaccacggcgagcggggtgccgtcggtgcggaccgtgacgtgccgggccagctcggcggggacggcggcgccgggcagccgggaggccaccacctcgccgaccaccggcggcggcagcggggtacaggtcagctccagggtgccgggcacgccgaggtcggcggcgccgtccccggtgtcggtcatcagcaccagcaggggcaggctgggcaggtccggggcgagcgcggcgagcaactggcgggtcgcgttgtccagcaggtgcgcgtcgtcgatcaccaggagcatgccgtcggcgcgccgggccaggtcgccgaggaaggccgcgccggccgcgaagacgtgttcgtcaccggcggccggctggccgctcacgtcgagcagcccgagatcgccgaagatcttgatgacctgggcgacgccggccgcggcggccgcctcggcgatgttcttctcggccgccgcccgcggctcgtcggccagccgctggacccgcgccatcgacgcctgcaccgcctcgcgcaacacggcgagcggggccggttcgtccggccggcaggtgccccacagcaccggcatcgcgctgacgctcgccagtccggcggcgtgctcggccaaccgggtccgcccggagccggccgcgccgtggatcagcaccaccccacccagcccggcccgggcccgttcccagcggcgggccagccggtcggcttcggcgtcgcgcccgcacatcggccatcgactcgccgcgggctcctcggccgacgcgccgcccgggcagtgccgcagggcgctgagcaggccggccgcgtccgggtagcggtcgtccgggtccttggcgagcagccggtgcacgaccgcggccaacgccgggtcgacgtcgggccgtttctcccgcacgtccgggaccggcgccgccaggtgcagacgcagcagctcccccacgtcgtcggcctcgaacggcagccgtccggtcaggcactcgaacagcaccacgcccagcgagtagaggtcggaccgcccgtccaccggccggcgcagcatcccggactgctccggcgaggtgtagaggaaggtcccgaccgcctggtcggagtccgcatcggtgtcccggccgagctgcgccagaccgaagtcgatcagcttggcccggccgtccccggcgatcatgatgttgtccggtttgatgtcccggtgcaccaggcccacccggtgcgcggcggccagcccgcgggtcagctgcgcggccagctcgacgcaccgctcctggctgaggatgccgtagacgagcaggtcggaaagcgccccaccggacagatgttccagcaccagcccgggtacgccgtcgatctccccgaccgcgtgcacccccaccacgcccgggtcgtcgatgcaggccagcagcgccgcctcgcgctggaacgcggtgcgcagctcgggcagctccccggcatccgcgaggggccgcttcagcgcgtagtcgtgctccccgcgccgcacgtgatgcaccatggtgaatgcgccacgacccagctcctcgactatctcgaggccggacagctcagcggtctgcggcccgctggggcgcacctggggggtatccgtcaccgaaagcactcattccgtatctgtctgcactcctgctcatcgaccgctcgccgccgaatctgaacgttcccggccaccggttgtcgaaccttttgatggacgtacgggccatccgcgcccgccgtgcctcgtccatgccgcaacgtcctgttcgtgctcacccgactgctcgccgcgctcctgacgctcccggccgccgcctccaccggttcggccgtcgccgcgcccgccggcccaccccgcacagcggtgacccatccggcggcgcacatcgtccgccccggcgacaccctgcccgcgatcgccgcccgctacggcctcaaggcgcggcaactgcagcgatggaacgacctgccggcggatttcgtaccgcacccggacagcgccctgcgcctgtccgcctcctaccggccccgcccgccctggcacacccgggtcgaaccggtcaccacccccaccgccccgaactgccccgtccccgccaccgccctgcgccgcgtctgggtcacctacgaggacttcaacggcgacccgcacgacggcagcctgatcgtcaacgagtcgatcgtgcccgccacccagaacgccttcgccctcctgtacgcctggcacttcccgatcatggccatggagccgctcgcggagaacatgcccgacctgaccgaccgcgccgccctgaccagcggctacgaatgccgcaacatcgccggcaccacccggtggtcgcagcacgcctacggcttggccatcgacgtcaacccccgccagaacccgatgatccgcggcgactacctggacccgccgaacagcgccccctggatcccccgaggcccctacctccccggaatgatccaccccggcggcgccgaactggccttcacgagcagcggcttccactggggcggccgctggcactccctgaaggactacatgcacttcagtcccaacaaccactgaccacctggccatccgcggaacaactccggtcccgggccgtcgccgggacctcagcgtgaaggcccggcgacggccttcacgccctgccccctcatcgggtagcgcagcggctggaagcgccggagagcatggcgaccgttgcccgactcctcgtcccgcgaccggaacggctcggaatccgcggcgccggcggcgacggcaccagaccggtcagcgggtcatggcgctcccgccgagcccgttctcaggactgggtgatctcgatcggggcggtgtcgttcgccggatcgccctccgcctggctgatgtgcgcggtgacggtgcccgggccggacacggtaccggtgaccttcagcgtgccgctccacagctccgaccagcccacgggatacccgtccaggtcgatgacgccgagaccacactcgtaccgcgcgaatcccgccgcgccggcacgactccggtcgacagcgccgtcgacgaacggggcgcatcgggaatcgatcgactcgacctcggtaccggacggcgcggcgaagtcgacccagaccggctccccgttggacgcggctcgcccgctggtcgggtcgatgaacgccgggccgtcgttgcggactccgaacgcgatcgggaccgactcaccgccggttgcgctcacctgcgtaccgaccgccacgatgtccgtggggttcggaccggtgcggaacgtgatggtgccggcgttgttccggtcgtccgcgggtttcgcacccggtcctgcgaccagcaccagtgagggtccgtcaccctgccgggtgtcccacggcggctggtcgtcctcgctgctcatggcgtggaccgagtacagcacccgggcgttctcgagttccggggtgtccggggcgacccggtacgccagcggtgtctccggactgagcgcgtatcgatcgccgggcgcgacgacgacgcccggaaaccggcaggtggtgctgtaggcgccgtaccaacagttgtcatgccgggtcacgaagctgtcggcgccggccatgatgctgatcgaaacgccgtgtgcggtggtgccctcctcacccgcccgggccacgttgtccacgatcaccgggaggtcgatcgtgctgcccgcctgcaccacgtcggtgagctgggtggactcggcgcgcaggtccggagaggccgacgccagcgcggcgtgcggtgtgacggcaacggcgagggtgacacccacggcacccgccgcccaggtcttcagagaaccggcggcacgccgtccacggtgttcggtcgagatcatgcgccgcatgatagccgcgacgcgctggggcgatagcgggatgcgtcaatgccgtcagcgttcggcagagagatgtcgcagtgcgatcgcggtcagtactcgttcttgatgacgaagtaggagccgcggatggtgccggccagcttggacttctggcgggcgaacttgaacgcgccgagttcctccgggatgtccatgccgtcggagagtttgaagccgacggcacgcttgccgccctcgtcgacggtgtacatcacgttgatcgacaggccgctccggtagaagacgtacgccatcttgatgttctcgacctggaaccgggtggcttccaggggcggggaggcgatcacgatgccgcgctccgctttcaggatgtggctgacccagtcgacggtcgccgtggcttcggtcgccggctcgaccgtgaagacgtggtcgtacttgttcttgaagtagcgggcctcattggcgcgcaggccggcgagcgcgtcggcgaccggtgacgattccaggccggtggtcgagacggtggtgaagtcaacggcgtagctcatggtgggatcccctgccgaacgacgatgccggacctccgactgtaacggctcacccggccggctatcggtggaaggtgaggaacagggcgacgaccaggaaccacaggttggtggtggccagatagatccgttcggccaggccgaagaacgggcgcagggccggggccagcatggtgatcacgaccgcggccaggccgaaggcggccagccagcgcagggtgagcagcagcagcccgaccgtgtcgctggtgaagctggtcagcggggtggtcagctgggccaccgagaggtagacgaaggtgaacgagaggatcgccaggatcaggtggatgcggccggtccaggtggtccgggtgctgtccatgccggccgggaagaaggccagggccagccgggtgatcgggatcagcagcaggatgacgtagtcgctgtgggtgaagccgagcaggccgagctcgtcggcgagggcgccggtcatggccaggatgccgaggctgttggcgatcaccgcgatccggaaccggccggcggtgggcccgacaccgtagtcgctgaccgcgtcgcgcagcgggtggtgccgggtgtcccgcacgtgcagcgcgaccaggatcgcgaagtaggtgagcagcaggatgacggcgatgagggccagcaggttcgcggacaacgggggcagcctcgaatcagtagtgctcgctacgacgagagccgatcttaagtgccagcagttgttccgcggcggcccggacggcggcgatctgcgcggcgtgcgcggcggccagccggttcaacaggtcctgcgggtcgacggcggtgaatcgaatcggcgggccgggcgcctgctcggcggcgccccgggcgaccaggcggcgcagcgtctcgtacaccttgggttgcggaacgccggtgagtttcgcgaccgcgtacccggtcagcggaccggcgccgagcaggccggcgtagcagcgcgcctcgtacggcgagaagcccagctcccgcagatgtgccaccaggcgctgggtcggcatccctccacaataggcagccgatgcggcaggcatggcggatgaccgcttccggatcagccggcgccgtctgttcgtcaccaccggagccggggttgtccaccctcgacgtgcgggcgatcctgcccgggcacggcgagccgctgccggccggggcgaaggagatcctgcagaaaccggcggcgtcgatctgacgccgccgttccctcacggtccgctatcgctgatgctgaaccttgcggacggcggtccgcgtgatcgtctccagttcgtgctggtccggcggctccaggttggccagcagcacggtgaccaccacgccgcgcacggagaccgcgatcatcttgccgtgcacggtcacccgcgggctggtcatgtctacctcgaagtgcacgcccgccgaccggttgccgagcttcggcacgctgagcggcatcgtcaccatgtgcagcgcgtccggcgtgcccggcttgccctcgtcgtaggagggacaccggcgcggcgcctgcgccacctggccgacgatgtcgcgggcggcgcggtccccggccgggttgatcacctcgatcaggaccggcccggcgtcgcctttcatgaacgcggcccggaccgtggggtccgccggtttcgcgggcgggttgtcggcgggcggcgggaccgtcctagctagctaggaccggcggcttggtgccggtgggcggggtgtcggcgggcttggtgtcgccgggcttggtgtcggcaggcttggtgccgcagtcgccgaccttggagccggtgtcgctgaacgccttgagcgcgtccggcaccggctgatacccctccggcaggtctttcccggtgagcagggccttcttcagccagccgggcaccggtccggcgggtgacccggacggcagcagccgggcgccggccacccccgcgggtagcagcgtggtgccggtgaccagggagggcgccgccgcgtcggtcatcagctgggccagcgcggtgttcttcaccggcgtccagacggaggcggcggaggccggtgcggcgacggcgagtcccatcccggcgctgaccgagaaggcgagtgccattttgagcgatttatgccgaatcatctgcatttcctcaccctagccgcggctcctccggaccaccgtgaccttcgcgggatttcgccgggagggtcggaccgggcgggcgcccggcgtcagcatccgcactcgcgagcgcccggtcgctatggtccgaggatgagcgctctgccgaaggaactccgcgatctgatcgaatccggacccatcgcccatctgagcaccaccaacgcgaacggcagcccccaggtgtccgccatctggatcgggctggacggcgacgacgtcgtcagcggccacctcggctggcggaccaagctgcgcaacatcgagcgggacccgcgggtcgtgctctccttcgacgccccgcgccggcccggcgtcttcctggccgagcatgcggtgctgcgctgccacgccacgctcgaacacaccggccgggcatgggacctgctggatcggctggccaaggtctacctcgggccggagcagacgttcccggcaccacgcgccgaggggtggatcgcccgttaccgggtcgaccgggtcggcggcgtcggcccctggaccgcctgaccgcttccggtccgccggcgttccggccgcttccgatcggccggtacgtcggtcagctccgcccggggccgccatcgtaccggcgtgggcggcgtaggctcgtcgactgcaagcgggagaagaggccctgggtatggaccacgcacacgagcacgagcacgagcaccatgatcacggccatgaccatgaccacggcgggcacagtcacggggtcgccgccgacgccgaccggcgctggctgagcctcgccctcggcctgatcggcgcgttcatgatcggcgaggtggtggccggtctcatcgcccactcgctcgccctgctctccgacgccgcccacatgctcaccgacgccggcgcgatcgtgctcgccctggtcgcgatgcggctggcggcccgcccgccgcgaggcggctacaccttcggcctcaaacgcgccgagatcctgtccgcccaggccaacggcctgaccatgctgatcctcgcggtctggctcggcgtcgagtcgatccgccgcctgatcgaagcgcccccggtcgccggccgcctggtcctgatcaccgcgctggtcgggatcgtggtcaacctgggcgccgcctgggcgatgagccgggccaaccggtccagcctcaacgtcgaaggcgccttccagcacgtcctcaacgacctgttcgccttcatcgccaccgcgatcgccggcgtgatcatggtgaccaccggtttcacccgggccgacccgatcgccaccctgatcgtcgtggtgctgatggtcaaggccggggtgggcctgatccgcgaatccggccggatcttcctggaggccgcgcccaccggcatcgacccgcccgccctcggcgcccgcctggccggcgtccccggcgtcgtcgaactccacgacctgcacgtctggcagatcacctccggccagccggcgctctccgcgcacgtgctggtcgccgaaggcctggactgccacgccgtccgctccgatatcgagagcctgctccgccgcgactacaagatcacccacagcacgctgcaggtcgaccacgccgacaccgaccccacccggtccaccggctacgaggtcgacctcgccgacccgggcgggcactgcgtcgactcgcacggcgagtcgtaccgggtgtagccgccggccgctaccgtggacgaccccgcgccgagaagtgaaggaacccgatggccgacccgttgaatccgaccctgatgacccggatgcgcgccaccctcggccgggaacgcgacgcgtccctgctggaggcgttgcgcaccgcgggccgggtggcctacgacgagctgatggccgcggagaaggttcgcgagcagctcggcgccgacgggacctcggtgtggaacgccccggtcgcgatcggcagccagctgctggccgcatggaacggcttcgttctgcagaccctcggcgaaaccttcctcgacgccgactacgccgccaacccgggcacggtcggctacgtgccgccggtcacctacgagcagaccgcgcgctggttcagcgccgtcgagggttgggtgtcccgggcccggcaggcccgcgtcaacccggactacgacatcagcgccgagctgggcctgcccgccggactgccgatgtgggccgaggtcgaaccgtgcccgccggaacacctcagcgcgttactggccgccgtccccccggtccgcgaacacgtcgacgtcgccctgttcgccctggagaaggccggcgtcccggacaaccgccgcaaagccttcaaccggctcaagcagctcgtcgccgaagccgccgcggccgccgactacgcggtcggcctgcgcaccacccagcacaaccccgccctgcacgagctgatcgagaacaacctcaagcaggccctggaactctggttccacgccggccagctggccgccatgcccggcctcctcgacagctaccgcgcgctgcgccccatcgcccgccccgacccggccaccctccccggcggcgcccgcttcgacccgtggtgcctcaccgaccgcgtcaccctcccccgctggcagcgcgaccaccgggcgatccaggccatcagcgaactctgggaatacgacccggacccggccgcgaccctcgccgtcaaagccgacatcgacgccgccctcgccgccggcgacatcaccccgctgcgcacccccggcggcggcacctgctactacgaatgcccgtggtccgccctgtacgtggtccgccgcccggtccggatcgccggtcgccgcctgcaggtcctgcagcagttcacgatggaggcggcggccgacgacatgccccgcggcctgcccttccgccggggcatcctgatcggcccgttcttcccgacgaacgaggtcgaatactgcgaccccgacggccggcactgaccccgggtgacgccttcttcggcctgctcccggacggtcgaggagcagtaccggccgccgcgggtcgtggggggggtgacccgatgttgtatcaactgagctgtggatgtgaacctgtgggtctgcggtcgccgtggacatctgacgtatgcgccggtcgaggaggagttccgggcccggctgcacgcggagacggcgctcggcccggtgtggcggtgtctgcgctgcggggatttcgtgctgggtgagccgcggctgtcgggtccggccgctgacgcgccgctcgtgccgcgggggcgggcgctgcgggatgcgatcgtgttgcggctgctggcggtggagcggttcgtcaaggggatcctggttctcgccgccggctggggggtgatccagttccggggcagccgggacgccgtgcagcgggcgttccacgaggatgttccgctgctcaagccgttcaccgacaagatcggctgggatctgcagcattcggcggtcgtggacaccatccggcgggttgtcgaggcccggtcggacacgctgttgtgggccgggatcgcgctgatcgggtacggggtgttgcagctcgccgagggcaccggcctgtggctgctgaagcgctggggcgagtatttcgcgctggtggccacgtcgctggggctgccgatcgagatctacgagctgaccgagcggttcacctggttccggatcgccaccctggtgatcaatgtggcggcggtggtctacctgctggtgtcgaagcggctgttcggtctgcggggcgggcaccgggcctacgaggcggagcgccacgagatgagcctgatggaggtggcggacgcggccggggacccgatccgggtcggcggctgagcccaccaccatgcggcgaccggccaccgccatgccttcgcgtgattgactcgtgtcaaatcgcgctggtaggcacggagtgtgacctttctgtggtcgtacaccgaggcgctggccggtggggatgtgggctggtggcgcgcggcgacccggcatgccgcggatctgctggaggcggatcactggtggctggatccgccggcgctggtgccggtgcagcacctgctggtggagacgaccgcgttgctgtcctatgcgctggcccgcagcgtggacggcgatccgggggcggtgaccggggcgcagctgggcggatgggcggcggcgcggccgttgccgctgctggacgagacggtgccggattcgctggaggggtcgttgtcgctgctgcagtggagccggatcttcgaggagcagcggctgcgccagcagaacgacttcgcccggctgctggtggcggccgggcaccggctgccggcgaccggcgatccggtcgcggacctctggcaggacctggtggaccgggagaattcgggccggcggtacgggttggccggtcgcctgcccggcccggccctggcgctcggtctgggcgccgtcaggcagcagttcgtgagtgccggcggagcagcaggtgggcggtgagcccggcgggcaggatcagccagaaggagatcaggcggtagatgagcaccgccacggcggcggccgcctgggtggtcccggccgcgatcagcccggccagcatgctggtctcgatcagtccgataccgcccggggtgagcgggatctgccggacgatctgcacggtcaggtagatcagcgccagccggtcccatccgatcccggcgtgcgccgcgtcggcggccagcagcaggcatcccatatcgagcagccagttcaccagcccggccagcagcacggcgatccaggtacgcggttcgacggtgcgcgcgtcccgcagcgcccggcggacggccggccggcgcagcaacgggagggcggtcagccgccgggacagggccgggcggcggcggatccacgggacggcggcggccgcggcgagcagggccgcggtcagcggcaccgaccaggtcgcggcgcagagcaggcccagcgacagcgccgtgaccacgctggagatcagggtggcggcggcggagacggccgaggtcgcgccgtgccggcggtagatctggaaggcgtaggcggcggacgccgcggcgccggcgggcagcgccatgctgagagcactgcggacgtacgtcatggccaccgcgcgccgcggcgggacgtgcacggcgaaggcggcgagcaggcggcgctgctgttcggcgtaggcgagctgggacagcaggccggcggcgagcgcggacaccgcccaccgccgatcggcgccgcggagcgccccgaggatcgacaccgggtccggcagccgggtgcgcagcatcgccacggcgagcagggcgaccggtgcgagcagcgagtatcgggcccatcgccgccacgcccggtgcgggccgggcgtggcgggagcggtcgacgtcacccgttcagcgttccggatcggatcgccgccgtcgtcctccccggggaggcctaggggatactgcgacggcggtaggggaacgccggcgactcggggtcagaggttgatcatgtgcccggccaggccgtggaccgcctccttgaccgcctcgccgagggtcgggtgggcgtgcacgttgcgggccacctcggtcaccgtcaggtcccactgctgggccagggtcagctcgggcagcaactcggtcacgtccggtccgatcagatgcgcgccgagcagctcgccgtacgccgcgtcgctgatgatcttgacgaagccggcggcatcaccgagcccgtgcgccttgccgttcgcggtgaacgggaacttcgcgaccttgacgtcgaagccctgctcgcgggcctgcgcctcggtccatccgaagctcgcgacctgcggctggcagtacgtggcgcgcggaatcatccggtagtccagcgccatcgtctcggcgccggcgatcgtctcggcggccacgatccccatcgactcggcggtgtgcgcgagcatcagcttggcggtcacgtcgccgatggcgtagatgccgggcacattcgtacggcaatagtcgtcgatctcgaccgcgccgcggtccgaaacccggacgccggtcgtctccaggccgtagccccgggtgttgggttggaaaccgatcgcctggagcaccctgtcggcctccagaatctcggtccggccgtccttggaaacggtgacccgaaccgatgcggcggtctcctcgatgctgtcgacccgggtgccgacccgcacgtcgacgccgagccggcgatagtgccggagcagttccttggagacgtcctcgtcctccagcgggagcatcctgtcgagaaattccacgatcgtcacgtcaaccccataattgcggagtacgtacgcgaactcgaccccgatcgcgccggcaccgacgatgacgatgcgttccggcagctccgcgtcgaggatctgctcctcgtaggtgacgacccgatcggtgacggtcgtgcccgggatcagtcgcgtgctcgcgccggtcgccagaatgcagttgtcgaaggtgatcgtgcggtcaccggcccgcagggtgtgcgcgtcgacgaattcgccgcggccctggatctcggtgatcccgttcttcttcatcaggtagtgcacgcccttgacccggccgtcggccacgtcccggctccggcggtgcgccaccccgaaatcgaaggtcacttttccgtcgatgccgaacgtgtccgcctggtgctggaagatgtgcgccaattcggcattgcgcagcagcgccttcgacgggatgcagcccacgttgaggcagacgccaccccagtatttctcctcgacgatggcggtggagagcccgagctgggcgccgcggaccgccgcgacgtagccacccggcccggcacccagcacgacaagatcgaaatgttcacccatgagcgaacagtaatcgttgcagagagctcccggggccgggccgagctcgcggcccgtcaccggctacccgccggcgggtgtgtcgcttcgcgactgtccttcgagggaggtgccgacctctatggacagaggcgtccattcgccgatcgaatcactggaatcggtcgaatcgacagggtaggccgctcctaccggagagcttcccgcgcgcccggccggtcaattcctgtggaggagccagatcacgccggagagcaccaggcagccggacacgatcttgatggccagttcgccgtggggctcgtgccgcttcttgccgaagccggccagagccaggccgatgatcgccgtgaacggggcgccgaggaccacggcgagaccgccgaagacgtacgacacaatggtgtagacctgggacggcgccgggccgggacccgggtaggcggcatagggcgggccgtactgcggctggccgggcgggccgtaagcggccggctggcccggaccggcgggctgaccgtaagcaaccggctggcccggaccggcgggctgaccgtaagcaaccggctggcccaaaccggcgggctgaccgtaagcaaccggctggcctaaaccggcgggctgaccgtaagcagcgggctggccgggcggggcgtaaccggtgggctggcccggcggggcgtacggcggcgtggccggcggcgtggccggcggcgaatacgccggcggagcgtagcccggcgcgccggaggtggggccgctgtaggcggcgggcggggtggcggcgaaggggtcgccggtggtggggccggtgtacgggtcgaccgggacgccgtagggcgaggtgggcatggcgcgggtcgccgggtaccgcggatcggtcaggctcccgccgagcgcggtggtgggcggggcggccagcgggtcggggaacatgccggcggcgggatccggggtgggccggccgcagcccgggcaggggccggccgtgggcgccgcggtggaaccacagttggtgcagatcatggatacccctccgggtgctcgcggcggcgccgtcgagctcccggaacgggaaccggtcagcggtggctggtcagcctagcgcctcgtcgtagagccgctccagaccgcgcgtctgctcggtcaggtcgaaatgcgcggtcacgtgcttgcggccctgctcgcccaggcgctgccgaagctcctcgtcggcgagcagccggcgcagcgacgcggccagcgcggccgggtccccctcggggctgagcaggccggtctcaccgtcgacgaccgcctccgggatgccgctgtgccgggtggcgaccaccggcaggccgagcgccgccgcctccaggatcgtggtgggcagaccctcggtgtcgccgtccggtgcggtcttcgacgggcaggcgagcagccgggactccagcaggtgacggcgcacctcgtcgggcggcagactgccggcgaacgtgacgtcgacgcgcgactcccgcgcccggtcccgcatcgccgggagcagctcgccgtcgccgatcagcagcacccgggggcgcggctcgtccagcatggacagtgcggtgagcaggtcgtcgacgcccttcttggcgacgaaccggccgatgaacacgacgtcccaccgcttcggcagcggctcgacggtcgccggcaccgcgatgccggtgtagtgcaccctgaccttggcggggtcggcgccccagcggatcgcctgctgacggatcacctcggagaccgcgatcaccgtggtggcccgctggaagacgctgtgcaggttgcggcggtaccgcacgcctttcgcaccggggctggacggctgacgggtgacgtcgtgcccgtgcgcggtcaccacgagcggcaccccgagctcccgggcggtgtggctgaccagccagccgtcgccgctgaagtgggcgtgcacgagatcgggtcgtacgccggcaagggtgtcgcgcagttgcggtgaggtgccggtgagccgcagccgcaggaagcccttgccgcccggaaaggcgatcacgtcgtcggggcgggagagcaccgactccatccgggtggccccgacgtaggtgggccgccagcgggtcagcgcgtcgccctggttgcggatgaaggtctccgacccgggcagcatcgcgctgcgccagatcgcgacccggcgctcagttgccatcggtggcgaccggctgctccggcgccttgcggccgacgacgaggtcacgcaggcggtggcgcatgctcggcgggagggcccagatctgcatgtgggtaaggtagtcgaccgcgccgggccggccgtggccgcgggcctcggcgagcagctcgcggaacagcttggcgttgcgggtcggcgcggccatcgagctgagcacgctgagcgtgaaagcggcgtacgcccggggggtgaacagctcgcggttggcgcgcagccagtcgagctgctcctgccacgggttctccaggctgatccgctcgcggttctcgtcctggtgccagaggaccagcggctcggcggcgtagaccagctcggtgcccggctcgcgcagcgcccgcagggtccaatccagctcctgctggcggcgcaggccgacggtgaacggcaccttcagccagagctcggtgggggccatgatgcaggaggtctgcacgaaaccgtcgccgtagaacaggccgcggcggaccaccagatactcgctgatcggctcgcccggctcgggcagccggcggggcatcacgttgtcggcgcgcggggtgcggctgatcatccggcaggcgatcaccggacgctcgctggtggcggccgtggcgagcgccagctgccgctcgatcttggcgggcagccactcgtcgtcgtcgtcgagcatcgccgtccagcggccgcgggcgttgcgggcgccggtgttgcgcgcgttcggggccttgccacgctcgggcagaacgatcaccctgagacgggagtcgccgatctcgtcgagggccgccacggtcgcctcgtccgggccgtcgacgacgacgatcacttcgaggttctgatgggtctggccgagcgcgctgcggaccgcgcgaacggctagctcgggccggttacacgtcggaatgacgacactgacatccggctctgaagacatggcgactcgctaacggcggggatggtacggcccgtaccgtagggtctcgggcggcgcaatggataacagcaggaagatagtcggtggggaacggggtagcaacaaccgtcgccacagcgtcacccagcgtcaccttcatcaaaacgtaatcaggcgcacaggaaaattccatctcgcgaaggcaatctttcgccctgcggcgcccgtcttcaagggtggaactgccgtcctagatttcatggggcggaacgaccgcccggagactaggagacccctcttgagcaagaccagcaaacgtcgcagacgtgcaccccgctgggccttctggaccgtggtcttcggcaccgtgctgctcgtcggcggcggtggcggggcgatcggcctcaaggcgaccgtggccgccgcgacgtcctcgatcgaccagaccaccctgatcggctcggccgcccccgccgaggagaaggccaaggtctccctcgacgggccgaagaacctgctcctcgtcggcatcgaccagcggcccgaccagaccaacggcgagccgctgcgctccgactcgatcatcctgctgcacatcaacaaagaccacaccagtggttacatgatctccctcccccgcgacagctacgtcaacatcccggcgtacgacaacggcgcgcagaagtggggcggcggccggacgaagatcaacgccgcgttcgccttcggcacccgcgggctcaagggcgacgacgcgctcaagcacggcttcgagctgctgaccatgacggtgaaggagctcaccgggatcacgccggacgccggcgcgatcatcgacttccagggcttccgcgacgtggtcaacgtgctcggccgggtctgcatgtacgtggacaccaccaccaagtcgatccacctgggcaaggacgccaagggcaacaccgcgcacccgtacgcgatcaaccccaacggcacgctgaaccacaagatcgccggagtcacgccgaacatctacaaaaagggcaaccagtgcttctcgccctcccaggcactcgacttcgtccgccagcgtgacctgctcgaggacaactccggggactacgggcgccagcggcatcagcagcagttcttccgggcgatcatcaaccaggcgatgaaggacgggctcgactcgccgaccaagctgccgaagctgctgggcgccttcggtaaggcgatgaccgtcgacacccgcggcgtcgacctggccgactgggcgctgtcgatgcgcagcctcaagccggacaagctgatcaccatcaagagcaacgagggcaaactgaactcgcagaccatcccgggcgtcggcagtgccgagatcctctccccggacacgatggacctgctcaagtccctcaagcgcgacgacgtggccacgttcctgctcggccacccgaagttcgtcgccaccagctgaccgcagccctttccgcacggcgcccgcaccccctcgggggaccgcgggcgccgtcgttttcagccacccggcggcccggcccccactcacgtgcgcccaccccgggcaccccggcccaccgcggcccgcggcccacccggcagccccgagccaccacagccggcggcccacccagcgacctcaacccaccacagcccgcggcccacccagcggcctcgcgccaatcgtccgcggcgcttcaagcgatggcgagtcacccaccgcgcgggatccatccatagatcctgggcgatcagccgatcgcgactgaaccggcgatcggcggcacacgcagcgctcagcgcatcggatcgacgtgcggcactataccgatttatccgctcttcgcgggtgatgtcctcatgcggtggccggcggttcgggggtcaccgtggcggcgcggtcggagtggccgaggtcgcggcccggagccacccggtcacggaccaggcgcttgagttgcggcaggtcggggaagccgtcgggtttgcggctccagagcgtttcgtcgtcgaggcgtacctcgaagactccgccgatgccgggcaccagggcgacctcgccgaggtcgcgaggaaacgtggtgagcagctcctgcgccagccatgcggcgcggagcagccagcggcattgggtgcagtattcgatctcgaggcgcggcgtccggttcgtcacaacacgcgagtatgccgggagacaaccggcgcccacccgcggagcaaccggtgcgaccccgaatcgggccgacgccgcaagggcggaccccaagcgggccgacgccgcagcgcgcggaccccaagcgggccgacgccgcagcgcgcggaccccaagcgggccgacgccgcagagcgcggacccgaagccgaccgaacgacgcgtaggccggcccgaggtggggccggcctacgcggtggggcggtgggtcagttcatgccggggggctgggtggcggtcatgccccgccaggaggcggtctcgtacggcgcgaggacgagggcgcagaccgggtcgccggtgcagacggcgccgtggacgacgaagtcggggccgtcgaactcgtcctcgtgacccttcaccaggtcgccgaggctggccttgatctgttcgcggacgaaggcctcgctggtgccctcgtgttcgacgaacaggccgccgcggccgtcgcggcgctggacccagccgatgccggcccaggcttcctcgccgatctgggtggcgtgctgctcggcgtacacgcaatagagcttgtcgccccaggcgccgaccgggaccggggccttgccggatgcgtcgaccgtggtggacggcgggatgacgctggacaggcggaccaggttgtagaaaccgcactccatggtcaccagcgcgtcgtggaacgcggccagcgaggtggtgccccgcccgatggcgcgaacgacggggatctggtcgtagacgacggagtcagccatgggtctccctctgcggaaagcacggaaagataatgagaaatcgcccgaaggcgcgagtgcgtgacagctcgacacggggcgccgagacaccccgccatgcacaccgcgaccggcccagtcagggcgaaccggcgtgctcacttagtgtgccgactacgccacgctccgcagatcccccgcagagaccgtgagaaatgaccgaccgttacctaaagtcgcggcggctcacgtgttccagccagcgttcgatgaccgccacctcggcctcgtcgaagcccgcggtgagctgctggttcaggtcgtcgaccaggtcgcgggcccgggtgacggactcccggccgcgaggcgtcagggtgagccgtacggcgcgggcgtccgccgggtccggggagcggctcacgcacccactgcgttccaggcggttgaccaggccgctcatcccggacggggaggcgccgagggccgcggtcacgtcgccgatcagggcgttctcgtggccggccaggtagaagagcacgccggcgccggacgcgccgatgccggtgtcggcagagcgggcgtcgatccagcgccggaccgcgcggtcggcgttgaagagcaggaagatcaggcgaggcaggcgcacgcggtcatcttgtcaacatcaagcgagccggccgtacgcggtgcacaagcccacgccccacaagcccaccccccacaaccccacgcccacaagcccgacggcccacaagctgcgcggcacagcgggccgagcgccgagtgccccagctagctagctagcggcccggcggacagccatcgcctcgcccgggccgcgacagcgggacaggcgagacccgcgagaccagcgaaaccagcgagaccggcgagaaccgcgagacccgcgatccgcgggaccggcgagaccgagatggtggacggcgaagaggcggcgggaggcaggccgggcggtcacttcctcgcccgcgccgcgtgggcgcggagccaggccagcaggtcgggccagaccgcttcgctgagggtgcggcgcagcagcccgtggtggccgatcatcgggacgccggcggcggccggcgtgtaggtgcggcgttcgacgtcggcgccggtgaggtgggtggtgaggacgtccatctgtggcggggtggaccacgggtcgtcggcggcgccgaccgccaggacggggccggtgagggtggcggtgcgctcccgggcccgcatcgacggatcgtcgaagaagtagttgcccatccggacccatcggccccagtcggccatcgcggcggccggcaggtcttcgccgaggccgaggcggctggccggtacgtatccgagcagacgggcggaggccggcccgagcaggtggagcagcaggcggacccgggcgcgctcgaggcgggacgggatggtggtgatggccgcgaggtgggaggcgacgatcaccgaggcggccgggtcggtgccggcggcgccgagggcgatggcgtgcccgcccaggctgtggccgacggcgagccggggcaggccggggaaacggtcgccggcccaggcggcgacggcgggggcgtcgacgccgatccagtcgcgcatgccgacgtcgcggtggtcgcgcggggacccggaccgaccggtgccccggtagtcgtaggtgatcgcggcgatcccgtcggcggcgaggtattcggcgaaggcggcgtagaagccctgcggggtggccgtcgcggagtgcacgacgagcacggcggccggctcctcgggcgtgaacaccgtggcggtgatcgcgccgccggtggtcaccggaatccggaccgtctccttagttcgcatgcgaaataagataacccaccggcgcgaaccgtgccgcagcccagggtggtgggctgcggcacgccgccgggggtcagttccgcgatctccgggcgcggaccaggtacgtctgtgccaccaccacgacggccaggaacgccccgctgatcacctgctgccagttgctgttgacgttgcccacctggttgatcaggttctggatgaccccgagcagcagcaccccggccaccgtcccggcgaccgatccggagcccccggtcagcagcgtcccgccgatcaccacggcggcgatcgcgtccagttccatgccgctgccgagcacggtgacaccggagccgagcttggccgcgttgatcgcgccagccaggccggcgagcagggcggacagcacgtacaccgcgaccttgatccggcggaccgggaggcccatcagcgccgcggcgtcctcgctgccgccgatcgcgtgcaccgcgtggccgaagcgggtccggttaaggaccacgatgccggcgccgaccagcacggcccccacccagaccggcagcccgatgccgagcaccgcaccggtgccgagatcgtggaaggcggagctcctgaccaggtaggtggtcgagccctcgtcgctgatgctgcgcatcaacccgcgggcgccgagcagggcggccagggtcacgatgaacggcgccatgccggtgcgggagatcaggacaccgttgagtacgccgatggccccgcacaccagcagtggagccgccagcgccgcggcgaaaccgtactgcgacgcccaggcggcgaccaccccgccgagcgcgtagagcgagccgaccgacaggtcgatcccacccgtgatgatcacgaaggtcatgccgagcgcgatcagcatcggcggtgccgcggcgaccaggatggtgccggcgttgtcggcgctgcggaatccggggaacgcggccaggctgatcaccacgacggcgaccagcacggcgagcgcaccctgacgccggaccaccgcggcgaggcgaccgggttcgcggccggccggcagggggacggacatggtcaccgggtcctcctctcccgggccgcgtacaccgcgaccaggatgatcacggcctgcaccatctcggtcgtggacggcgggagatcgtgtttgatcatggtggcgaccaccagttgcatgagcagggcgccggccacggtgcccagcacccgcacccggccgccggtgagcggcgtgccgccgaccaccacggcggtgatcgcggagagctcgatcagcaggccgaccgcggacgcgtcactggactggatccgggagaccgacaacagtccggcgatcgaggcgagcacggcgcagaaaacgtacacaccgatcaggacttttctgaccggcagtccggcgagctcggcggccggccggttgccgccgatcgcgagcaaccggcggccgaagacggtgcgccggatgacgaaggcgacggccagcacgagcagcgcggcgatccagaccaggaccgggatgccgagcaggtcaccggagccgaggtagaggaagtcgtcgttgcggatgtccttgagccggccgccggagacgaccacggccaggccgcggccgccgacgaacagtgccagggtggcgacgatcggctgcaggccgacccgggcgaccagcaccccgttgatcagtccgaccgcgacgccggcgagcagcgacacgaggatcgcggcgaccacgccgtagcccaggtagagcgggatcagcgcggcggccagggccatcaccgagccgaccgacaggtcgatgccctcggtgccgatcaccagggccatgccgagcgccacgatcaccaccggcgccgcctggatcagctggatgcgcaggttgctcagggtcaggaagtacggcgtgaacgcgacgttgtaggcggccagcagcaggatcgccgcgtacacgccgtatcggggcagccaggccgcgctgacggcggcccgggggcggcgggtcagggtctcagtgctcatccgcggcctccgcgatcgtggccatcaggtcctcggtggtcacccggtcgccggacaggatgccgacgaccgcgccgtcgcgcagcaccaccacccggtcggcgccctcgaccagttcctcggcgtccgaggagaccagcaccacgccgagcccctcggccgccagctcgtcgatcagcgcctgcacctcggccttggcgcccacgtcgatgccccgggtcggctcgtcgagcagcagcaccttcggcccggtggcgagcagccgggcgagcagcaccttctgctggttgccgccggaaaggtcgccgaccggctggtcggggctggacgccttgatccgcagccggctcatgtaggtccgcacgacctcgtcgatcttcttgtcgctgaccaggcccatcctggtcatccggggcaggacggccagcgcgatgttgtcccggatggacaggccgggcacgatcccctcggccttgcggtcctcgggctgggtggccacaccggcccggaccgcgcggaccgtgctgggccggccgagtttcgtcccgccgacctcgatgtcgccggcgtcgatcgggtacgccccgccgatcgccttgatcgtctcgctgcgaccggcgccgagcaggccgccgaggccgaccacctcgccgggtcgcacgtcgaagctgatgtcgtcgagccgcggccgactggtcaggccgcggacccgcagcaccggctcgccggtcggctcggcgctctcggccgcgccggtgaagctggtgaagtcgtcgccgaactcgcggcccagcatcagggaaaccagccggcgccggtccagatcggccatccggccggtgtgcacgagtctgccgtcgcgcaggatcgtcaccgcgtcgcacacctggtagagctcgtccagccggtgcgagacgtagacgatgccgatcccccgggcgtgcaggtcacggatcaccccgaacaacgtctccacctcgcggggttcgagcgacgaggtgggctcgtccatgatgaccaccttggcgtcgatcatcacggcccgggccagcgccaccatctgctgcgcgccgagcgccagggtgccgagacgccggcgtacgtcggtgcgcaccccgtagccggccagcagctcaccggcctcgcggaccatccgcgcctcgtcgagcagaccgaaccggttgcgtggttcgcgcccgaggaacaggttgtgcgccacgctcatcagcgggacgaggttgacctcctggtagatggtcgagatgccggcccgctgggcgtccagcggggtgccgaaccgcgccggttcgccctggtaccgcacctcgccgccgtccggctggtagacgccggtgagcaccttgatcaatgtggacttgccggcgccgttctcccccaccagggcgtgcacctcaccgggctgcagcgtgaacgacaccccgtccagcgcgcgcactccggggaaggccttcgacacgccggccacttccagcagcgccatgcggcgccctcctcacaagccggtccgccgcccgggcacggttgtcgccgcgaccggacggcgggcgatcactcagtacgcgctgccgacatccgtcttggcgttgctctcgtcgtacgcccggtcctggatcacgatgtcctggccgaccggcttgccgccgaagaagtcggtggcggtctggaaggccagcgggccgaagcgcgggttggactcgatgaccgcggagaaccagccgtccacgatgccctgcacggcgcccttggtgccgtcgatcgagacgatcttgacgtcgccggccttcttgcccgcgcccttgagcgcggtcaccgcgcccagggccatctcgtcgttctcgccgtagatgccgttgatgttcggcttggactgcagcagctgctcggcgaccttctgcccgtcctcgcgggagaagttgccggtctgctcgaacgagatcttgatgtccggcgcgaccttcgcgatctcgtccttgaacccgctggtccgcagcgtcgtcacgttgttgccgggcgcgcccagcaggatcgccacctcgcccttgttgcccagcgccttggccatcgcgtccgcggcccgcttgccctgctcggcgaagtcggacccgatgaacgtcaggtagtccttgcaggccgtcgcgttgatcttccggtcgatcgtgatgatcgggatgtgcttggccgaggccttggcgaacaccgagtcccagccgtcggagttcaacggggcgatgaccagcagttgcaccccgccgtcgatcatctgctcgacgtccgcgacctgcttggtgaactgcgagttcgcgttcgtcgtcttcaggttggcgatgcccagcttggccgcctcgtccttgatggactgcgtctcggcgatccggaacgggttcgcctccttctccgactgggagaagccgacctgcgccgtcttcaggtcgagtttggcggcgccgtactgctccagggtgcaggtggggccgctcgcggcggcggactggacgacctggctggcggccggacccgcgctggccgtgccggcggtgccggagtcctcggccttcgaacaggcgcccgcgccgagcagcagggcggctgcggcgaaggtggcggcgacggacctagggcgcacgaaagcgacgtttctgaacatgggagccccctcaaagcctcacggcttcacacgcaaacgctagttgatcaatcactggtccgatcaggattgaacacattcacccatcgacgctaataatctgtcaagaccccgaacggtaacccgggcgaaacgtgacatcaccgcaacgtgagcgttcacatacggacggcgcgggcggccggggcgctggcgggccgcgctgcgacaagagcggggtcgggtgcgcgggagcgagtggcgaatgatccggccgccgataaacgcggtgggccgccgtcacatatcgacagtgggtccatctccgctgaccacgacggatcttgcgaaaagcggcgacgcccagggaaaacgatgaaggttgatcaaggcgctgctcaccaggccggcgcgacccgcgcaccggccggcagctcggcgcgtacggagagcgaggtcgaaatgagccgaggcggaaatcgccctccggaatagagcgctctctcactcatatggcgatcacaaaatcgcacatcgacgatgtggtgagcgttcagatctgaatgtccgccgcgcggtcgaccccggccgggccaggcaggctcccgatggttaacgcaaccatggcgagtctctcgaagatcgccatggccgggccgggccgccgcgggatcgagggaaaaacggacaaagcgctcagccgcctggccggtgaccggtcaggcggctgagcgcttcttcccgcgacaggtgccgaccgggcttcacggcgacggccggcgaaccgtgatcggcagcttcggctcgcggccggcgagaccccgtccgccacgtcaccggatcagcgacgcggagccgttcctagagctggttgatccggatcaggttgccggccgggtcccggaaggcgcagtcgcggatcccgtacggctggtcggccggctcctgcaccacgtcggcgccgccggccaccagccgctcgaacaccccgtcgaggtcctcggtggccagcgtgaccgcggcgtagctgcccttggccatcatctcggcgatcacccggcgctcatcgtcggtgatgctcgggtcggcggccggcgggtgcagcacgatcgacaccggctgccctttggcaccgaccgtgatccaccgcatgtccttgaaaccgacgtccttgcgcacctcgaagccgagcacgtcacggtagaagccgatggccgcctcggcgtcgtcgtgcggcaggaaactggcctgaatccgaatgtccatgcggcccatgctaggaacgaccggcggtccgggcttctcgattcctgaccggtctggtgacctgtttcgccacacagttcggcatcccgtcggtcgcgtccgcggcggtccgccggtacgcgctcggcgagatcccgaccagctcggtgaaccgggtgctgaacgttcccagcgacgaacaccccaccgcgaaacagacctcggtcacactcagatcgccgcgccgcagcagcgccatggcccgctcgatccgccgggtcatcagatagccgtacggcgactccccgaaggcgctccggaactcccggctcagatgccccgccgacatgtgcgccccgcgtgccagcgcctccacatcgagcggctgagcatagtcccgatcgatccgatcccgcacctgacgcagccgtttgagatcacgaagccgctgctcaagaccgcccatccggccatggtgccatgccgcggggccggcgcgggtcacccggccaggccgaggtccgccagcagctcggtcaggtcggcggcggtcagctcgtcgatcggctggccgggctgccggagcgagccgtcggcgatgaacccccgccgccgcaggatctccttacggaccgccagccccaccccggcctgctgctcgaagaccagcagacggaggaatcgggtgtacgtcgatttcgcccgcgcgacgtccccatccgcccaggcgcgacagatgtcgatcaacgcctcggtgtaggcgaaaccggtcatcgtgccggccgacccgtgccgcagctcgtcgagcagatacatcccgcccatgccgccgaggatggtccgacccggcggcagcagcgcccgggtgcgcgcggtgcggaccggtgtcggcagactctccagtttgatcgtggtgatcagcgggaccgccgcgacgagctcggccatctgctccggggtgagatcgacaccgctggccgccgggaagtcctgcagcacgatcggcaggcccacgctgtcggccacctcacggtagtgcgcggtcagcgcctcccccgcggtccagcccttcggcggggcgatcatcagcccggccgcgcccagcttgcgcgcctcggtcccggcctgcaccaccgtggccgtgtcgtcgtggctggctccgacatagaccggcacccgaccggccaccgcctcgaccgccgtggcgacgaccaggctccgttcctcggcgttcaacctgtgcgcctcaccggccacgccgagcacggtcaccccgtcgaccccggtcgccagcaccccgtcgaccagggtgccgatgctcgcggtgtcgacccccaggtccgcggtgaacggtgtggcgagaatgttgaagactccacgaagaccggtctcggtcacgacggcttcccttccacgactactagatgtcgtccaacggatcgaaatcgaccagcagcatgtcccggaccgcgccggggccgagcgcccgcaccgggctcacctcgtgttccacccggcggtcgtcgacgatcagggtatccaggcgcccggtcagcgtcgtgctgaacacgggcttgtcatcacctggcatgaaaacgagggaggacccgccggagcacgactcccggccgatcaggtgcatcgccacatagagatgtccatcgaagtgccgaccttcgggggccggattctcgggatgatccgggccgacggtcacccggatgaggtggataccgatgccgaaggcgcgcggctcgagccggccgatcacgtccaggtcgaatcggagcagcgtgcgcagggcggatgagcgcaggaacgacgtaccgaccggcgcgaaccggcgagccgcaccccggtacagcgggatcgtcgcggccgactgggtgaacggcgcgccgggcaggtcgtcgagccggtattcgccgtccgcgccgggcaccgccgcgatccggccgtaccgccggcggcggaaggtcgacccgccgggcagataggcgtcgggctccagtctggaccacgcggccaggaaatccggcactgccgccggcggcatcaggggcagcagacccgtcccggcgaccgccgccacaccggtgccggccagcgcctcggccgctgcgccgcgcaggtcagccactcgcgctcccggccacctcggccgcggccagctcctccagatcgaccagctcgaccccggtgtaccggtcgaaggactcggaatacttgagctgctccttctcgatgtcgaggaactcgcggagccggtccgacgggtgccggtagatgacctggacgccggtcgtgtccaccgcctccaggctgtcgaagatggtcaggtcgcgcaccagcttgcgatgcggcggcaggttgtccagctccaggtcctcggcccagacgatgcgcaccgcgatgccggcctcggtctgcgcccgcagcgtgcgccagctgcgctcgtcccaccgcccgtccggcgcgatgatctgtcggcggctgaggaagaacgtgcgcgtgaaggtgacgccctcggccgagcgacgcccgctgacctcgacgatccggcggaaccgggccagtgagtcccatcggtagagcatcggccgggtcaggctgacgttggacgcgtacaccgtggaacgcgcccggtcgtagagcatcggggtgcggatcgcggcgatgtgcgacggcacctccccgatgctcagcctgcgggccagcaggaacacctcggcgcgcagctggggatcgtcgatctcgtcgatcatccggaagaggtccagcttctccgccatctcggcggtgatgtgcgcgcggaactccttctgatcgctgttcatccgctgttcgatcagcgccaccgccagcgagaccacggcaccggtggacaccacgatgaacgtctcgttgttggacagcttgaacacgatgtcggagagcaggccgatcaccaccgtcacagaggcgctgatcagcgacatggcgtaattccggaacgctgacatctgaacctcaagctcgctcgcggacggaccctgatggccgcatggtaacggcgcggcgctcccaaaccgtgatcaattcccgcagtatcccgggctgcgcggcctcggtcacggcggcggcggagcacagctcggcgaccgtcgagcggccgtccgccagcgacagcacgcggtgcaggccggcggagacgtccacccgctgctggacgaagtgcgcgctggcggtcgcctcgatcgagtggtggaagccggacccgtccggggccgggcgggagaccagcttgcggctcagcggcacgccggggcacagtgtccgggcctgctccgccagatccaggccgggccggcggcgaaccaggaagtcgtcgaccaccagcaggtcgattcccgtggtcaggaagcagacgacgctgtcgtcgaccgagtcggcgatcggctccgcattgttgttgaacgacgtgttcagcagcgccggcacaccggtcaactcgcggaacgcgtcgatcagcgcccagtaccgcggctgccggctccgggagacactctgcacccgggcgctgccgtcgacgtgggtgaccgcgccgagcagctcccggtgctcggcccggatggtcagcgtgtaggtcatgaacgacaggtcggcccgggcggcgggcatctcgacgagaccggccaggtgttcctgcagcaccgagggagcgaacggccggtagccctcccgtttcttgaccatctcgttgatgcgcgatttgttcccggccggccgcggatcggccaggatgctgcggttgccgagagcgcgcgggccgaactcggaccggccgtgcacccagcccacgaccgcgccgccggccagctcgcgggccgtcgtgccgatcgggtcggtcagccgggtcacctcgacgagccccgaccacgccgcgagccgatcggcgatccgcgatgccgatggcaggtcggtgcccagcgacaggtgcggcatcgccgcccggccgccgccgcccagcacgtggtcggcgtgcagtgcggcgcccagcgccccgcccgcgtcgtgcgcggccggttggacgtagacctcgtcgaacagcccctcgtgcagtaaccgcccgttcagggtgcagttgtgcgcgacaccgccggcgtagaccatccggcgcagtccggtgctcgtcgcgaaatgccggatgacgtgcagcaccacggtttccagggcctcctgcagcccggccgcgaagtcggagtgcagggtggtgaacggctggccggaccggcgggccagcggcagcagcccggcgtcgtggatcagtccccagcgctcggcccgggtggcgagccggaacccgccctccggccgcagctcgtagaactgctcgaacagcgaccggaaccgccgcggatcaccgtacggcgcgagtcccatgaccttgtactcgtcgaaccgccggtagcccaggagacggatgctgtccgagtagaggtcgccgagcgaatgcgggaccggccactcccgcagcacctccaggcccgcctcgccggcccgggcgaccatcccggacagcgcgtcgccggacccgtcgatcgagacgccgagcgcctccgggaatccgctcggcccccaggcgctccacagatgcgcctggtgatggtggcagaagtgcagacggtcggcgacgtccgtggcgaagtgccggtcgaagatctcccgcagggcgtcccgcaccgtcggggtcccgctcgacgggtcgtccaggaaggcgttgggcgacggcagaccggcgtccgccggaaagatctcccgggtccgctcctggaaattcatcgccaccacgtcgacgtccggaaggcggacgcccccgatctccaggcatcgggcgatggcccgggcggggaagaagttcgagtgtttgacccggttgaggcgttcctcctcgacggccgcgacgatctgcccgtcccgtagcagcacggctgcgccgtcgtgggtcgaccagccgggcccgagatcgtcccactccggtctgatcccgccatgccacccgagtatgagcacccggcctcccgtcccgatgtccgtccgatcaggacggcagtcggaacaggatcgcagacgcaggcggatcgcgaccaccccccggccgttcagcggcggcggcgccagcgggggtcccggctccagcgggggccgacgacgcgccattcacgggcccaggatgcgcagcggtggcggtccagcagggcgcgggtggtgcggtgcaggccggccaggaaggcggccaggcagaggatggcgcagagggcgaccaggatgccctgcgaggtggggctgtgccgcaggggtggcgcctgcaggcggccggtgtcgtcgacccagatcgcgatccgggcgccggcgtggacctcggtgggagtctggaccaggccgctgtgggcggtgccgtccggggcgatccaggtggcgcgggcggcctgcggggcggcggtgcgggtgccgatggcgccgtacgtgccggagtcctcgaccaggaccgcgtcgacctggaagacgtgcgcgcgttcccagtcgcgggcccgcacgtccgcgcggtagctggccgcgccggcccaccaggccagcagcggggcgcccgcgaggaacgtgaggaccagaacgaacatcaccaggctctcgacccggtccgaggtgcggcgcaggaggttccgttcccagccgagccggcgcgcgatcattcccgaagcctctcccggaaacaagcccggacgacgcacatcctcgcactgtccggcccggtgaccgccggaaacgaagcgccacgccgggcggcggcgccggtcgatcaggacagcgtgagcacgtggaaaccccacgccggcagatcgacgtagagcccctcggccgccagctcgctgccggaccgttcgaagacccgcccgtccaaccggtcgaccagccgccacgcccgcccggccagcgacggccagggcaactccacccggccctgcgccggccgcccggaatagttgaccaccaccagcgccgcctcccacgcccaggcgagcaggtcctgatgggactcgttgtcggcccacccggacgtgccgagcagccgccaccgcccccgccggacggccggcgccagccggaccagccggcggtgaaagtcgcgcaggcccgggtcgagatgctcgtcgcgatagcgggccaggaacaccggcaggtgcgcgcgccggccgtcgaactgcccgtcgtgccacagcgtcgccccgggcagggtggccatcgccaccgccgccgcccggttccgcccgcccggcagggtcgccgcggcccgcggctcgtcatggttctccaggaaccggatcagccgctcctgatagcccagcccggccgccaggtgccggcgcaccgacccggcgtcctcgtgggcgaggcggtcgtagagccgcttgtcgtagcagaagtcgaagccctgctgctgcagcagccactcggtctcccagtacacctcggcgatcagcaccacctccggatgccggcgccgcagctcaccgatgagcgccggccagaactcgtcgtccgggcgcggaccggcccagcgaccccaggtgccggcgaagatgtcgttggtgagcagcatcgccatgtcgcagcgcatcccgtcgcactgctcggcgatctgcgacatgacggccagggtcgcggcccgcatcccgggggcgaacgcgttcagctgggcgacatccggccacggcggaaagtacgggtcgcggccgtgcgcgatcacccgcccgccggcgtggaaccagccggtcgggtcggcggccagatcgtcctcgctgccccggatgaaccagtccggatgccggaccaccgcgggatggtccggcgcgacatggttcggcacgtagtccaggaccagcttcaacccgcgtctgttcagctcggcgcgggcggcggcgagcccggccgggccaccgaggcgatcgtcggcacggtagcggcgcacacagtacggcgagccgaccacgtcctccggcgccagatcgggcagcgcctgccggaacgcccgctgcagcccgtcgttgacccgggccaccgccaggcccgccgggctgcgctcccagacacccatcagccagaccgcgtccatgccgggcgcggccacctcgtcccagacctcggccggcacgtcaccgagggtgaccggacggccgaaacggcgggtcaggccggtcagccacggccaggtgtcgatctcgtagatcgccggagcggccggccagccggtcatcacgcaactcctctaccggaacggtccctggccaccgtatcgtgccacgccgtccgacgaccgactgatggccgccgccggacggacggcccgcgcctcatcggcgacgctcaccgcccccagcaccacgaggccgatcaacccggtcctgaagatcccccgcatcctcatccttcccttgcacgaacccccaggtagatcaacgaacgaacccccggaaaatcaggttcatgaggcagatgtcgtgcgctgcggccgacaactgaccgtcgctcatcggggggcgagcgggtccggcgatgcggccgctgcgcgtggcgaacaatcgccaggccgttccacatccgctgtcggtcacgaaagagctttcaccaggctctgcgccgcggcgagatcccgcgcctcggcggcggcggggtcgttgccggctcgggggccgcgcgggcgcagggccaggatctcgtcgacggcccgcgagtcgacccgcatcgtgtcgtacgcgggtgggtcggcgaggaaggccagagcggcggcggggaggacggcgcggacgtcggtcagcgcgctgccgaggccccggagcagcccggccgcgccgacctcggccctcgccacatccggatgggtcagcacgtcgcgcaggctacggtcgcccaggccggcgtaccgcgccgtcgccatccgatggcccacggacccggccggagagtcggtccggtcgtctccggccgcgccgcggcagagatcgagccggtcggcgggcggcggataggactcggcgcccgcgccgtcgccggcgtcgcgcagggcctcggcgaggatcatcgggtaggcggggccgcaggcgacggtggcgacgacgtcggcgaacgcctcgcccagccagggggtccaccgcgcggcggtgccggcgtccagaccggcgagcgcggcgggaaggtccgcggtcaggccgcagtcgtcctcgacgtggtgcccggcctcgtgcgcgaccagcagcaccccgggcaggtggccggtgagataccacgggatgccgatcaccgggaccggcagttcgcggaccgccgtcagcccggcggtcgtgcgcaccccgcggggcagcaggtcgcggtagccggcgccgcgggccgccgcgaacgggaccgcgccgcggtcgaggaagaccagcggcggctccttgcggccggcggcgacgcccgcggccagcaccgagggccggtacaccgcccaggccagctcgtcggcgacggccaggatccggctcagcgggccgacccggcgcagcagcagtttggcgcggaagaagtcccagacgtggaacaggtcgaggaccagctcgaaggtgtccgcccggtcgaggccggcgccgagcagccgggtgatcgcctcgatctggctggtgtgtttcgccatcggctcggtaccggccagctccgcccagtacgcccattcgtcgcgcagcccccgcaccgcgtgcaccagctccgcctcgcgcagcaccgccggcgaaacctcccgcgggaccgccggcgcagcctcccgcgggaccgccggcctagctagctaggcagcctcccgggacatcgcggggaaggcctcccccggcgtggtcacagcagcgccgtcggggcggcgaacagcgtcgtcgaccgggccgccagcagctcgtcgtcgcgtttgaagtccagcggccggccatccggcaccccggccggccggatcgcccgcaccaggtcgagcggtgaccggccgtgcgccagcccgtccgcgatggtcagcacatagtcaccgccgctgcggatcagcccggtcgccagcacggccggtacgcagccctcggcgaacacgtgcgcggcgaacaggttgcgcagcacgatctgccacggcacgtcgtagggcgaccccgggtacggcgggtcgagcaccagcaccggctcccgcccgggccgcccggaccgcagcagccggaccacgtcggagggctccagcacgctgcccggcccgagccggaagtgcggcccggagtcccggtagtcgagccggccgcacacgtgcagcaccgccggctcgtcggcgagcacctgctccaggccgggcaccgagcgcacctgatagccgcaccgctggtacagatcggccacgtggtagccgtagtcctcgtgcgaggttccggcgacggcctgcaccaccaccgcgctcagccgccgggcgccccggtcgcgggccaccgacccgcgcagccgggcgagcggctccccgcgcagcggcggggtcaggtcccggcaatcgagcgccgccccggtctccgggccgagcaccccgtccacctcgacgaccgcgccgagtgtggtcagcgcgtactgcagccagcgcacgtcggccggccgggcccgggacggcatggcccgccacagcgccggggcggcgggcgtggccagttcccagggcaggccgtgaaggagcacgtcgtcggagtccagtcggtccggcgggacgggcgcggcgagggcccggcccagctcgagggtgagggcacgccagtcctgcacgagccgcacctgcagctcgtagaaggtctgcgggaccccggccggccaggtcagcgggtgcgccgccagggccgcgacggcgaccagcgactccggttcggggccgccgaacatccggccgagccgccagtccaggtcggtggcggcggcccgcagccgcgggtcacccaggtgctccgcggcctcgcggtagatgtcgatcgcccagcgggacggccggtcgaccgagcggcacagccggaccgcctcggcgtaccacgcggccgcgccggtgccgagtgccagccggcgcagcccgaccgcccgcagcagcgggtacgacggcaccgggagcagcgtctcgggctgagccagccgcccggccgcggcgtccagcatccgcgagccgagcagcgggtcggcccggctcaccggctgcagcaccacggcggcgcggtccggatcgccggcgaggcgttccagcacggccagcagaggcagttgggcgggcccgtcgtccgggtggtcgggcggccaggtgagcacctcgcgcagccgggccacctcctcggccggggccgggccggggtgccgggccagctcggccagcaccccgagccgggccgacggcggactgatccggcccatcgcctcggccagcgggccgagcaggtgccggtgcgccgcccagtcacgcgccagccgggccgcgatcacgacggccacctgctgcggtgggccggtgaccggctccggccggtcctggtcgagccgttcggcgaccagctcgtcccacagcacgccgatccggtcgtcggccggcaccggcggccgctgcagcgcggccgccgcccgcaggtcaccgacctgccgcaccaggaaacgatgatggaggtacgccgattcggggtgcccctcggtgaacccggcctggctccacagggcggcggccagcttgaggtcgtgctcggcctcgtcgagcagcagcaggtcgccgaggaccagcgcgcgttcctggtggacccgggcgagcagggcggcccggcggccgtcggtcacctcgccggcggcctcgaccgcggaaccgaggtagccgaccgccgcctcgctgatcccgagccgcccgcaggcccggccgcacagccggtgccgttccacccgctcggccggggcgtccggccggacccgggcgagcacctccagcgcggtccccggctggtacgccgagatgagcagctcggcctcgcgcagccgggcccggacacccccggctcggcggcaccagtcgagcgcccggtcgaaccgaccggctttctcggcgtcccgggccagggccagggccagcggctccacctggtccggccggcgctgcccggccaggtccagcgcctccgcgaagatcaccccggaggcgtggccggccgcgtcggcgaggacccggagcaggtcgatccggtcgtcggcgctcgccttcggcagggcggcgacgaccagggaggctgcctcggtggatcggtcaccgacgcagagggtcgcggcgtacatggcaaccgccagcccaccagccggcagctgggccgcggtccggagccggtcggcgcgggccaggaaaccctcggcctcgttccacagcgggtcggcggcgggcgcgccggcccgccgggcgcgctcgatcgccgcgtaggcgagccagaccagcgcgtcggcccgctgccccggttcgatcacgccgtccgggtagtcgccggtgagtacgtcgcgggccagtccggcgagtccgtccaggtcgccggcggcgcgccgggcccggatccgcgcgtcccagtaccgttgcgcgccggggtcaccgagctgcacccggtggtagtaggcctcgcgctcgaacggcgcgggagcctgcgggtgcgccgcggccaggtcgtcgaagcgctgccggaacgcggcgtgcaggtccagcgcgaccggctgggcggcgatcagctcgcgcatcggggcgcgcaccttctggtggaagacgaccagccgtccatcccgatccggttcggacacccaggagcgttgcgccgcgtagtcgagcagccgccgccagaccgcctccttggccgacacctcaccgccgaccgggaagacgccgtcgtcgccggcgaggtggtgccggtcggcgcgcgggtcgtcgcggtcggtgacgccggagcggccgctgaccaggaacggccacatcatgtggaggtcggcgtaatacagccggcgcgggaccaccccgtagcggaccagccagcgcacatccggatcggggatccggcggatcacccggtcgatcagcagccgcagcgccggatcccggtaggcgcgcaggtcggccgggctggtcgccggctcctccgcgatcaggtcggcgaacatggcgaccaggaacgggtgcccgccggtccgctcgaccaccgcggcgaccaggtccggatcggtgatgtgccggatctcccgcagatatcggccggtctgctcgggggtgaagtcgccgagcgcgaccggccgcacgtcgccgaacgcggccagcgccgccccggcccgctcgcgcaggtcgtagcgcccggccaggatcagccgcagcgacgggcactgggcgacgatccgggccagcgcgcgcagcaggtcgtcggcgcccgggccgagcagcacctcctccatcgtgtcgacgaccagcagcaccggtccggcgccggccgcgtcgttgaaccggcggacgaagatctccgagacggcccgttccagccgctccgggtcctgcgcggtgagtccctcggcggccgcccgggcctgttgcgaatcctgccggtcgagcaggccgcggtacgaggcgaagcggtccagccgttcgaagacccgccgggcccagcggcgttccagctgctcggcgatgtccagcaggagcagccacgggtagcgggcgctgaccaccgggtcgaccacgtcgaagtcgatccgggcgcacgggatgtcgaactcggccgggacgcagcggcgggcgatcagccactgcagctgcacggtcttgccggtgccggtcggcgcgaacacctgccagacccgcggcccgcggccgtcgagcagcgcgtcggcctgcccggccagcccgtccggctccagatactgcgccgagcggctccacgtcgccgaccagaacagccgggcccgcagatagccggcgcgttccagccgcagcgccgccacctccggcccggcgtaggtgagccgcttcgggtcgccgagcacgtcgatcaggtcctggcagcgggcgaagtcccggttccggtcggcggcccggaactccgcctcgaacagtgcgatcgcggccgccgggtcggccaccagcaggtgccgcagccgctcgatctgtgggccgcgcccggccagccaggccgcgatgtcggcctccagggcggccagccggtcccgggccggctgccactcgcccatccaggcgaccgcctccgaccggcggatccgccagcggtcgtcgccggcccgctccagcaggccacggccggtcaactcgtcgagggccggggcgtccggggcgccgtgcgcggccaggaccgtgtcgtacagcgcgcggtcgaagtcgccggccgcggcgcagacccgcaacgcccgacgccagctctccggcaggcagtcccgctggatgtcctccagggaacgcccggcggccagcagccggacgatctcggcgagccgctggtcggtcacggcgccaccggcccgatcacgtcgagcacctcgtcgaaccgggtcacccaggcctgcgggctcaccccgcagatcgccccgaacaccggcttgagcagctcgaacggtagcccgcggcggcggcagtagtcccgggccaggcgcatcatctggggtgcctcgaaatcgccgatggtgaccaccggaccccagtaggcctggtcccggccgggcagccgggcggccagccagtcggccttgccgaccagcatcagccgcagcccgccgccggccgcggcgaccgggcgcagcaggctcggatagatcgcgctgtcgaacgactcgggcagcacctgctcggcgttgtccagcgcgatcacgtgcggccggtcaccggccgcggcggccagcgcggtgcggaagccgtccaggatccggtcgcgctgctcggcggcgcgcggccggttctcgtcgaaccgccaccgctcccccgaccagccggccggctccccggcgagggtgccgaacagcgcgtcgaagccggcgaacgccgcggccggcagcggctccgcctgccccggatcggtgcacgcctcgcgcatcatctgcagcacgtgcagccacgtcttggtgagcgcgtgctcgccgtccggccgggccagcggcactcccaggtccacataggtgacccggtagccgcgcaggaagtaggtgagcaggctgaaccgggtgaaccaggtcttcccggtcggcttgtgcgggttgccggagcggccaccgaccaccagcagcgaccgcggcggggtcgcggtcagcgggtccagggcccaccaggcgtcccgccggccgggcgcgtggtccaggaagttgcggagcatctggtactccgggcgggcggtcaggccggcgatctgctcggccggccggcggaacccggtgcgcaccacatcggccgggtcggtgcggcaggtcagcaccgggatcgcccactcgccggtgtcgccggtcgtgcgggccagttcggtccgggccgcggcgaccgcccggtccagccccagcccggcgaagatgccctgatagagcaatccggcgaaggtggcggcggccggcgactcgacgtcggcctgcatggccaccacagcgccggcgccggcccgcaggaacgcctcggccacgccgccgacctggtccagggcgtcggccgcggtccggcaggcgttgaccacgaccagccgcggcgtccagtcgtccgacatcatcaggccgacctcggtgctggccagctcccacccggcgccctgtggccgcccggcggtcacccagttgaaggccagcgcggcggcccggcccgggacccgcggcatgccgtggccgatgaagtgcagcacgtgcggccgcagccggtcgatctccttggccagccggtcccggtccggcccgtcgacgatctcgatgtgcgcgcgggccgggcactcggcggccgccccggtcagcccggccagctcctcgtcgccgagcacctgccgatcggtcgggttgcagaccaccaccagcacccgcagcgggccgtccacctcggcgccggcccgcggcggaccgccccgccagagggtgccgccgcggcgcagcgccagccggtccgccccggaggcgagcagctcccagggcaggccacgcaacggcggcgggatccgcaggcgcagccgcagcggggtgccgtcctcgtcgacctcgttccacagccgggcggtgtcctcccggatcaccgcgtcgaacagctcgcgacccagcttgccgcgggtctcggccgggatccggcggtccagcgccccgtcgaaatgcgccggatcgagcacaccggtgatcgtcgcggtggccggcgggcgacccgccacggtcagcgtgacggtccgctggtcggcggcgacggccagctcggcgtccaccgtgctcacagcggctccagcaccgcatccgggtcgtcgcgggcctcgtcgaccagcagcggcggcaccgcctcgggtgcggcgccccgccccggctggcgcggcccgtaatccgtcgccacccggtgcagccacgtccggcgcagccggaacacccggtagaacggggtgacctcggtgccggaccactccaggccgacccggctggaccgggccaccgcgacgttcccggccaggtcggccagtttcagcgggccggcgccgactgtcgcgtccacccgcagctcggccgaggcgtccgtgtcggaggcggccagcacggtaccggccgcggccgtgaccacgtcggtgaccccggccagttccggcgcccacacgccgttccagaactgcttgaccagattgccggcgaccgcccgggtgtcggcgaaacggtcctgggtcagcccggtgaacagcgccagcacactggtgtcgcccttgaagctgaccagcgcaccggcgtcggcctgggccagcgccgagaagcccggcggggtggtgccggacagtttgaacgtgacctgggccgagccgttcgcgtcgtacaggaagtcggccggtggcgcggccgccgccgcagcgccggccaccccgtatttcgtcaggtcgccggcgggccggatggtgccgccggacgtgtccagcacgtcgcccacccggacccgctgcgacagcggccagttgatccaccagccgtgccaggcatcccgcatcgccgaccggtagctgccgagagaatcgcccatgatcgccccctatggcacctcatcgtcctccgcgggggcgggcgggcggtattaccggatcaaccgaggcccggccgccgatcatcgggctgataccgcctcacaggttggtcatccgctccatcttttccggatagcgctcgccctgcaccccggcccggtccgcggccgacccgatctcggccagatctgccgggctgagctccacgtcgagggcacccaggttctcccgcagccgctccagccgccgcgtccccgggatcggcacgatccacggccgctgcgcgagcagccaggccagcgcgatctgcgccggcgtcgcacccttgccggccgcgatccggccgatcagctcgaccagcgcctgattcgccgcccgcgcctgagccgagaaccgcggcagcccgttgcgcatgtcgttctcggcgaacacggtgtccgccccgatcttcccggtcaggaagccccgcccgagcgggctgaacggcacgaacccgatgcccagctcaccgagggtgtccagcagctcctcctcgggccgccgccaccacagcgaatactcactctgcacggcgctgaccggctgcaccgcgtgcgccctgcgcacggtcgccgcggacgcctcggacagcccgaacgcccgcaccttcccggccgcgatcagctcccgcaccgtcccggccacctcctcgatcggcacgtcgggatccacccggtgctggtagaacaggtcgatcgtgtccacccgcagccgccgcagcgaggcgtcggccacccgccggatgttctccggccgactgtccaccccggccccctgccgcccgtccgccccgatcacgaagccgaacttggtggcgatcaccacctgctcccggaccggctgcagtgcctccccgaccagctcctcgttgacccacggcccgtagacctcggcggtgtcgaagaaggtcaccccccgctcgacggcggcccggagcagtccgatgttcgcttcccggtccggacccggcccatagccgtggctcatccccatcgccccgaacccgagcgccgagacggtcagttcccccagtttcctctgctgcatacccggcacgctaccgatcgccccgccgcccccacctgtgatcttcaccctccccggtgcacgccgtgccggctccggatgccgtccgcagcaccggccgatcgactcgatggggtgaccactatcggtcagcggcgcgcgagcacctagggtggcgggatgcgtacggtgattcgtgggatcgtggtgttggcgctggtggccgggggtggcgccggcatggtggggcccgccggagcggcgccggcggtgacgttcaagaactgcactgagctgaacaagaagtacaagcacggggtcggcaagcggggcgccgaggacagggtgagcgggtccaccaagccggtcaccaccttctccgtgaacaacgatctctatgcggcgaacaagaggctggaccgtgacaaggacgggatcgcctgcgagaagcggtgagcggggtgatcgcggggagtggcggctcggccgctacctgaggccctccgaggcccgggcctcggtcggcgccagcgcgctggtcaaggtccgggccgtgtcgatcagcgggacgtgactgaaggcctgagggaagttgccgaccaggcggccggtggtggtgtcgtactcctcggcgagcagacccacgtcgttgcgcagggccagcaggcgggcgaacgtctcccgggcctcgtcgtggcgacccatcagcgcgtagttgtcggccagccagaacgtgcaggccaggaacgcgccctcgcccgggggaaggccgtcgacgtcggcgtccggatgttgggtgtaccgctggacgaaaccgtcgaccagcaggtgttgctcgatggcggcgaccgtgccggcgacgcgttcgtcatccccggggaggaagccgaccagggggaccatcagcatcgcggcgtcgagctcatcggagccgtagtactgggtgaaggtcttgcggaccgggtcgtaacccttgtccaggatgtcctgacggatctcgtcgcgcaggcggcgccagcggtcggcggggccgtccaggccgaactcctcgacggccttgacggcgcggtcggcggcgacccaggccatcagtttggagtgggtgaactggcgggggccgccgcggacctcccagatgccctcgtccgggtcctgccagtgctcctcgacgaactccatcagtttgacctgcaggccccaggacgggtcgtcggctttgaggccggcccggcggccctgatgcagggcgtccatcacctcgccgtacacgtccaactggaactgctcggcggcggcgttgccgatccggaccgggttgccgtcgtagccggtgagccagtcggccagatactcgtcgaggcggcgttcgccggcgacgccgtacatgatctgcagctcggcggggttgccggcgatcgcgcgcagcagccatttgcgccaggcgatcgcctcactctggaaaccggagaagagcagcgactgcagggtgatggtggcgtcgcggagccagcagaagcggtagtcccagttgcggacgccgccgagtttctccgggaggctggtggtggcggccgcgacaatgccgccggtgggtgcgtaggtgagggctttcagagtgagcagcgatcggacgacggcgtcccgccactccccctcgtacgtgcaggcggacacccagccgcgccagtaaccctcggtcacgccgagctcgtgggccgggtccagcggggcgggcgagggcagatgcgacgggcgccaggtcagggtgaaggcggcgcgttcccccgcccgtacccggaaatcggctttggtggtcagattctcgccccgggtcggcacgtcggtgcgcaaccaggccgcgtccggaccggcgaccgcgacgagcgccccaccctcgcggtagacccatggcacgacgtgtccatagtcgaagcgcagccgcagctccatgccgaagtccacctgcccgcggacgccctcgacgatccggatgacggacggcgagtcggtgcgcggcggcatgaagtcgatcaaccgggcgacgccgccggccgtctcgaactccgtctccaacaccagcgtgtcgtcccggtagcggcggcgggtggtgaccacctcgccggacggtgcgatggtccagtggccgttctccgcctcgccgagcagcgccgcgaagatcgcgccggagtcgaagcggggcacgcagagccagtcgatcgatccgttgcgaccgaccagggccgcggtctgggtgtcggcgatgatcgcgtagtcctcgatcggcagggccatgccgagcctgtaccccgacgcgaaacgcgaaaacaaaccgccgccgggggcagtgcccccggcggcggcgcatccgatcaggctggtcagacccgatcggcggcgatcagaaggtagtggaaactgccttctgagtacgccgtgaggaaagcctgttcgatcccggtcgccacctcggaccgggcgcgcagctcccagtacgggatggtggccgcggtcaggtcggtgacggcgatcggcacgagatcgtgggcggcgagcgccttgaagtagtcgctgcgcgggtggatgtcacaggtgtagtgctcgttgatcctgttgaccgccttggagcgccggccggtcacgtcgttggcgcaaccggtgatgcacacgtagcggccgccgaagccgagcatccgggcgaactccgcgtacaggtcgaacaggtcgacgtacatcgtcgtctcgttcgtccagatcgcctgccgtgacccggtcgcgaatccggagtccagcatgttgcggaagtggaagcgcaccctgtcggcgacgccgcgctgagcggcctgctcgttggcgaaacccacctggtattccgagatggacaccccgtcgacccggcagccgaaccgcgcgttggccatgatgctggtgccgccgcggccggacccgccgtcgagcagcgcgtcgcccggccggatcgggccgaggtggtcgagcagcaggtcggcctgggcgttctccagccggtgcagctcggcgatgatccgctgctcgcgggtgtcggccgggccgtccagcacgctgaggtcgggctcgccgacgccgtagtggtggtggtacagcccgtcgacctcgccgaggcgcaggttgaccgggtcggcccggttggtgttccagtagctggcgaccgagcgctcgaagtcggtccgcagtggcgaagcaacagcacttgtcatgatgaatcctgttcagttggatgagtggtagcggccgctcgtggcgtgccactcgcgacttccgcccagccaggcccaggtgtccgcgagaaaccggcgcagctgcggcgagccggacgcgctcaacgacgcggccgaggtcacgaaggtgtgcatcaactcgttgtggatctccacggtgcgccggaccgcggcccgcggcgtgagccgctccccggacaccagcacggtcggcaggttgtgatcggtctcggactcgttcctgcccgagtagaggtcgttgaccagcacggcggcgttgcctgcggtggtgaacgccgcgcggacccgcggatcgaagaactcggccggcgacagctcgtacccggccagcacgtcgaccaggatcatcggcggcagatagctgttcaggtgccgctgcaccagatactcccagaccggcggggtgcgccggttggcgtgccagtcggcctcctgcgaccaggcgacgaacaggatcgccatctggtgctggaaccgggccagttgggtgaccgaggcgtactcggccaggtgttccatcgcggtgcggaacgccaccgagatcggctgcaggcggtgatgcttctcgaagtcggcctgatagcgcggggtcagcgaggccgggtcgaccaccgagtagaggttggccagccgcgagccgaccaccatcggatccgcgcccagggacacctcgtcgacgtagtagtcgtccgccgcccactcggcgaccagacacttcgtcgcggcgagcagccggtcgggatcgctggtggccgggtgggcgagcatcatgaagcggccgaagttcgccccgcgcagcttgtccagccggccggggtagatgccggccttctcggcccactggaccacggcgtcgttgacccgctcccccagcgcccggtcgtcgcgcagcggcgccgggcagaagagctccggctcgtcccggtccacccgaccgaagagacgggccgcggaggtgcccaggccggtgggccccgaggcgatcactgtgctcaccatgtcagtgggacagctcgacgtggtccaggatgcccagcgcgtccggcaccagcaccgcggccgagtagtacgcgctcaccaggtacgacatgatcgcctgctcgctgatccccatgaaccgcacggacaggctcggctcgtactcgtccgggatcccggtctggtgcagcccgaccacaccctggtcgctctccccggtgcgcatcgccaggatcgaggtggtgtgcgtctcggtcaccgggatcttgccgcacggcaggatcgggaccccgcgccaggacaggaaggtgccgccgtcctgttccagcatcggtggatagatgccccgcttggtgcactcccggccgaacgcggcgaccgcctgcgggtgggccacgaacatcctggtgccgcgccgcatgctgagcagctcgtcgaggtcgtccggggtgggcgggccgccccgggtgtggatgcgctgccgcaggtcggcgttgtgcagcaggccgaactcgcggttgttgatcatttcgtattcctgacgctcgcgcagcgcctcgacggtcagccggagctgctgctccacctggttcatcggctcgttgtagaggtcggcgacccgggtgtgcacgcgcagcacggtctgcgcgacgctcagctcgtattcgcgcggcgtcagctcgtagtcgacgtacgtgccgtccagcttcggttcgccggtgtgcccggcggccaccgagatctccgcctcgccgtgcttgttctgcggccggcggttcttggcccggaactgctcgacgtgcgtgcgcaggtggtcactctggccgagcagcgcggtgaacgccgagcgcggcatggccagcagggtcaccgcggtcatcgccttggcggtgtagtcccagatccgctcctcgtcggtgagcgacttctcgccgaacgcctccccgtcggcgagcacccccaggttgaccgggtcgccgtagttgccgacgccgaccttgttcaccttgccgtgcgcgatcacgtacacgtggtcggcgaccgagccgaactcgacgatcacctgaccgggctggtactcctgctgcacgaacttgtcggccatggcggccagcacgtccgcgtcgtcgaactcgctgagcaccgagagttcccgcagctcggccgggacgacccggacctgcgcaccgacgttggtgaagctcagccggccgtcgccgatccgataagtcatccgccggttcacccgatacgccccaccggcgacctgaacccagggaagcttacggagcagccatcgcgaagtgatctcctgcatctgcggcgcggtcttggtggtggtcgtgaggttgcgggccgccgccgtgctcaggctctgccgctgctcttcgtgctcttcctcgcggatctcggactgcgtgggagtcgccaccgctcgtaccccgttcgtcggttctgatgcgtcgcacttaaggcccgttctatcgcattgcaggggcctttgtcgggtttcacggaatatgcacacatgctctgagcagcgttaatagcctcagcagcaccatccacgacaggaaggaaaagccggtgcttcgtctgttcaccgccgcctcgctggcggcgggcgtcctggtcgccccgggcgcggcctgggccgccgacaccaccacgtcactgaccagcgccgagatgtacgcggcgctcaagagcgtggccggcaccaccgcacccgccgagatcaacggttacggcggcgacttcagcgtcacggccagcctgagcggtgcgacccagaccggctcggccctgttcgccgccgacccggcgaccggcctcggctactacaccaccaccggcacggcggtcggcgggaccggcggcggatacggcgccgccggcaagggcgactaccactacctggacgaccccaccacgcgggccgccgccaagatggccggctacgcgtcggcgaaatacgtcttcgcggccgacagcaagctcaccctcgactcctgggccggcgagaacctgcccgccccgtcgagcatggtggtgtccgacccgcggcacgccggtaccaaggtggcccacgacgacgggaccaccgactacagctacgtcgacgacgacaagatgacctggaccttcaccgtcaacacggccggtgcggtgaccgccggcaagatgagcgggagcggcctggaggacaccttccggtacaactacggaccgcagaccatcacgctgcccgccggcgaccaggtgatcgcccaggccaccctgatgaaggcgatggcctacctgaccatggccgccgacgtgaagcgggtggcgaccacggcggccaagaccaccgagaagaaggcggccggcaagaccgtcacggtgtcggcggtgcgcaagtacgcggccagtgaggcctcggcgtacaaccgcaatgccgaattcaaggtcatcgccgtcaccaacatcaagggtggcgcgcacgtcagcgcgaagaacccgttcaccaaggtctccgtgagctacacgatcaaggccgccggcaagcacgccgtcgtcaccaagggctgaacggcgacggcagccgcgcggtggcgtcccggcccgtaccgggtgccacaacgcggctgccgttcttcggcaaaccctcaggacacctcaccgttgcccgatggtcaggccatgagcgacgccgtccacgacgaatcccggctcgccgcgctccgcacctaccaggtgctggaccggccccggcccgcggtgctcgacgacctgacccggctggccgccaccatgttcgacaccccgatggcggccgtctccctggtcgaccgggaccgccagtggttcgccggcaacgtcggcctggccgacgccgagaccccgctcgacgtgtcgttctgcgcccggctcgtgccgacccgcaaaccgctgatcgtccccgacgccacccgcgacccgcacttccgggcctaccgcaacgtgaccggggacccgcacatccggttctacgccggcgcacccgtcatcgacggcgaaggccacgtgctcggcgcgatgtgcgtcatcgacgacgaggcccgggagatcggcgaccggcagatcgacgcgctcacctcgttcgccgggcaggccgccacccacctcaccgcgatccgcggccggctgcgcctcgccgaactcggcgacgaactggcccgcgccgcccagcgcgaggaggacctggtcgccaccatcacgcacgagctgcgcaccccggtcaccagcatccagggatacctggaactgctcgccgagaacgacgacctggaaccgtaccgccgcctgatcgaaccgatccaccgcaacgggcgccgcctggtgacgatggtcgaccacatcctggccggcacccggccgcacgacgccccgctgcccgccccggtcggcccgatcgacctgaacaccgccgtcgccgcggccctcaccgcctgccgcgccctgaccggcctgcgcaccaccccggtcaccatccacccggcgtcacccgccccgatcctggccgacctggcccggctcgccggcgccatcgaacagctgctgcgcaacgcgctgctgttcaccccggccgaccggccgatcaccgtgcgcgtcaccggcggcggccggccggccgtcgaggtgcgggacagcggcgtgggcattccgcaggacgagctgccgtacgtcttcgaccgcttctaccgcggtcagcacgcccgcgaccaggcggtgcccggcgtcggcctgggcctcaccatcgcccgtgccaccatcctggcccacctcggcaccctcgaggtgaccagcgacccgcacggcaccacggcccgcatcaccttccccgccctggactgaacccctgcccggactgacccgcccgcagggccccgccgcggaccgcgccccgatacggtgggtggatggagcggccgatgtcccccgacgacgtcgtcgcggtgatcatgcagcggctcgccgaccagcaccgggtggtgcccgcctatgtgatccgggacgccgtcgaggccgccctgcgccgccgcttcccggacggcccgctcgccgagatccggatcccgcccgacctggcggccgacctggtcgccggcttcggcagcggcgcggccaccgccgaggacgactccgccaccatgcccgcggtcctcagcggcgacgagaccggccggctgctggccgcactcggcctggccgtacacgtcgccgcgttcaacctggaccgcgaccgcctgcacgtcgcccagatcctcaacggcgcggcggccgccctggtcgccctgggcgcggcctcccgggccgcccacgccgacggcacctcggcggtgctgctctccccggccaccctgcgcaccgtgcgcaccgtgatggtcgccgtgctgcagggcatccgcggccgcagctggcaggccgaacacctcgacccggtcaccaccacggccatgttcaccgacgtgctgaccatgctcggcgccgtcccctgaaccgggccggcccttgccgctgacgaacatgttcgctacgatcacgttatgagtccacgacgcgtaccggtcagccgccgggatcggccggccaaaccgccgctgagccgggcgggcgcggtcgccgtgggcctgcggatcatgcgcgaggagggtctcgagcggctcaccatgcgccgactcgcggccgagctcgacaccggcccggcgtccctctacgtctacgtgcagaacacggccgagctgcacggcgcgatcctcgacgaactgctcgccgacctaccggttccggccgccggcgacggctggcgcggcgagctgatcgagctgctgtgcggatacacgcggaccctgttcgcccatccgagcctggcgcgctcggtgctgacgctacgcccgtccgggccgcactacctgcgcctggtcgacgcgatcctgggcctgctgctcgccggcggcgtgccgtccacgcaggccgcctggggcgtcgacctcctgctgcagctcggcacggccaccgccgccgagcagggcacccgcgacgagaccgccggcgccgacgacgagaccgcgctgttcacgatggccgtgcgggaggccccggccggcgagttcccgcacctcgcccagacccgcgaccacctcttcaccggcaccggcgtggagcgcctgaagtgggcattctccgccctgatcaccggcatcgagacggttgccacgaccgatcccacccaccctgcatgaaacggcccgccctcggcggcggccccgcacaccctttacgaacatgttcgtcacgaatgagttcgtcatgatcaggaggaacgccatgaccacccccgtcaccatcgtcggcgccggactcggcgggctgacgctcgcccgtgtgctgcacctgcacggcatcgccgccaccatctacgagctcgacgcctccccacaggcccggacccagggcggcatgctcgacatccacgactacaacggccaggtggcgctccggtccgccggcctgttcgacgagttccagaagatcatccactcgggcggggcggcgacccggatcctggacaggcacggcgtcgtgcactccgacgagtccgacgcgggcgacggcagccgccccgaggtggaccgcgggcagctgcggcaggtgctgctggactcgctgccggaggggacgatcaggtggggcagcaaggtcaccgcggtcaccggcatcggcggtgggcggcacgagctgaccttcgccgacggtgcgacggtccgcacggacctgctggtcggggccgacggcgcgtggtcacgggtgcgaccgctgctgtccggcgcgcaaccctcgtacaccggaatgtccttcgttgaactcgatctcctcgatgcggatgtgcggcaccccgggccggcccgaaccgtcggcgacgggatgctgttcgcgctcgggcccggccagggtttcctggcgcaccgggagaccgacggcagcctgcacgtctacgtcgcgctgcggaaacccgcggagtggattgacggcatcgactgggccgacaccgcgcgggccaaggcgctgctgaccggcgagttccccggctgggcgccggagttgcacgcgctgatcaccgaggcggacggcccgctggtgccacgcacgatccatgcgctgccgaccgggcaccggtggcagcgggtgcccggcgtgaccctgctcggcgacgccgcgcacgtcatgtccccgttcgccggcgagggcgcgaacctcgccatgctggacggcgcgtcgctcggcgaggcgatcgcggcccaccccggagacctcgacaaggcgctggcatcgtacgagggtgagctcttcccgcgcagtgccgcagccgccgcggagaccgcccgcaacctggtcctctgcttcgacgacaacgcgccgcagagcctgctggaccggttcgccgccgaccacgacgcccggtgaccgcgggccgtcacggccgcagctgtaccatatgggtgttttaggatatctcgcgctcaattatcggccgggtgtgccgaacagcgggacatggtggtccagcggcgggtccaggatccggagcgcgtggccgcggtacgcgcgaccgggctgctggacggcgcggagtccgccgggctgcggcggctgacccggctggcatcccggctgctgggtgcgccgactgcgctggtgtcgctggtgctcgacgatcggcaggtgttcgccacccagctcgggttgccgcggccgtgggcggaacagggcgggacgccgctgacccattcgttctgccggcacgtggtggacggcgacgagccgctggtggtggcggatgctcgggagcatccgctggtgcgggacaacctggcgatcgaggagatcggggtggtcgcgtacgccgggatgccgatccgggtggacgggcagacgctgggggcgttctgcgcgatcgaccaggtgccgcggatctggtcggagagcgagctggcgatcctggaggatctggcggccgcggtgtcgtcggagatcgagctggcgcgggcggtgcagctggccgaggagacgtccgcggtggtgcggcggatcctggacgtgtcgcaggacgcctacgtgtcgatcgacgcgaacggtctggtccaggagtggaacccggcggcggagcggctgttcggctgggtgcgcgacgaggcggtgggcgccgacctgagcaagctcatcgtgccggaggcgcaccgggaggcgcatcggcacggactggaccgggtgcgcgagagcgggcggtcgcgactggccgggcagcggctggagctgccggcggtggaccgggagggacggacgttcccggtggagttcaccctgcagacgacgagcatgtccggtgggcggccggtgttccacgcgttcctgcacgacatcagcgaccggcgggcggccgaggagcagttgcgtcggcaggccgagctgatcgacgcggcgccggcggcgatcatcgtgcgggatccggacgggacgatccggttctggaaccggggcgcggagcagatgtacgggtggccggcggccgccgcggtggggcgcaacattcaccggctgctgtccaccgtgttcccgaagcaggtggcggaggtggatcaggcgctggaggaggtgggcttctgggagggcgagctggtgcaccggcgcgccgacgggcggaccgtggtggtgctgagccggcacgtgtcgcggccggccgcgggcggcggcggccgggagatcatcgagacgagcaccgacatcaccgagcggcggcgggccgagcaggcgcgcgaggagagcgagcggcggttccgggtgcagttccaccagtcgacgatcgggcaggtgatcgtcgggctggacgggaacatcctgcacgtcaacgacgcctacgcgcggatggtgggccggtccgcggccgagctgaccgggtacggcgtgatccagctgacgcacccggacgaccgcgacggcgacaccgaggcgctggccgggctgttcgccggggagggcgactcgtacgagcggatcaaacggctggtgcacgccgacgggcacagcatcgacgtgcagaccggggtacgcctgatccgggacgccgacgggcggccgctgcacctgatcgggatcgtgcaggacatcaccgagcaggtccgggccgaacgggaacgggacgcggcgcaggtcgtgctggccgagcgcaacgaccagttgcagcgcgccaaccagctgaaactggaccttatggggatgctctcgcacgacatcggaaccccgctgaccgcgatcctgggctatggcgaggtgctcagcgaggcggagctgccgccgcagctgtcgaatctgaccgcccggatcatcaccggcgcgcaccggatcgacgagctgcgccacaacgtgctggcgatgtgcaagctcgacgccggggagctgaccacggtccggcaacccgtgccgctggccgccgcgctgcgcgacgcggcggacggggccgacgccgcggtcccgatcgactgcccggccgatctgtgcgtgctggccaatccggcgcacctgcggcagatcgtggtcaacttcctgaccaacgcccgcaagtacggcggcggggccacccgggtgacggtgaccgtggccggcggcgaggtggtggtcggtgtgcacgacgccggcgccggcgtgccggagcagttgcgggcacacctgttcgagcggtacacgcaggccgccgagaacgccgccgaggggcacggcctgggcctgcacatcgtggcgagcctggccgaggcgaacggcggccgggtgtcgtacgagccgggtgatccggccggcagcgtcttccggctgcacctggaaatggggtgacggccggcgccggatgtgcgagggtccggcctcatggaaccgatcagcgaggccgggatccgggcctcgttcgtcaactgcagcaagggtgaggcaggccggatcaagctgccgcccgacttccgcgacaccccctggggcgatctcgacttctacggcttcgtcgacccgtccgcgccgcagcgcgcggtgatcgtggtgcccgggggtgatgccggcccgatcggcatcctgttacgcaaggcggagagcggccgggccggcgccggccgctccagcatgtgccaggtctgcctgaccgatcacgcggccggcggggtcagcctgttcaccgcacccctggcgggggcggccggccgcaacggcaattcggtcggtgagtacctctgctccgatctggcctgctcgctctatctgcggggcaagcgccaaccgaagctgcgcctggtccgcttcgaggagacgctgaccgtggcggagaagatcgaccgtgcgctgctcaagttgatcgcgttcaccgcgcgggtgtcgcgcgcctgagccgttcgaaaccgtcgagcagcaggtcgagggcgaactcgaagtggaccttcccgctcgccgaggcggccgcggcgatgcgccacccggaggtggagcacgcccgcgccaaggtcgtgctcaccgtttagggtcgggtgatgaccgcggtacgggatcgtttcagggaattgcacgaggccggcacgttcgtcatgccgaacccgtgggacgccgggtcggcgcggctgctggccaacctcgggttcgcggcgctggccaccacctcgtccggattcgccgccaccctcggcaagctggatcagcaggtcacccgggacgagctggtcgcgcacgtggcggcgttgaccgcggcggtcccgctcccgctgaacgtggacgccgaacggtgtttcgccgacgacgccgccggcatcgcggagacggtggacctgctggccgcggccggggcggccggcctgtcgatcgaggactacgacccggcggccggccgggtcgaaacgctggagaccggcgccgagcgggtggccgcggcggcgcgggcctgccgccggcacgggatcgtgctcaccgcccgcgcggagaacctgctctacggcatcgacgatctcgacgacacgatcgcccggctgcgggcctaccgggaggccggggcggacgtcgtctacgcccccggcctgcgaacggcggcggacatcacccgcgtggtgaccgacgtgccggcaccggtgaacgtgctggcgctggccggcgcgccgagcgtgccggagctgaccgagctcggggtccgccgcgtatcgacaggcggcgcgctggcctgggccgcctacggcgccctccgcgacgcggcccgcgagctgctcacctccggaaccacggccttccgcgaccgcgccctgctcgaggctgagcgggaggccgcattccaggactgagcggtgcggtgactcgggcggtcccgctcgccccccggcccggacgaggcggattccggcaatgccgacgcgggtggccgcgggatcaggacggcgccgcgcgtcagagttccgggtaggggccggcggccggcagcgacagggcgatcgtggtgccctggcccgggctgctcacgatggtgacctcaccctcgtgtccctcggtgatcgccttgacgatgctcagcccgaggccgagtccctggacctcggcccgttccgcgtccgccgaccgccggaacggtgccagcacccgggcctggtcggccgggctgatgccgattccggtgtcctggaccagcagcatcgaccgcccgtcccggctggccgcggtgaccgtgatggttccggtggcggtgaacttgatcgcgttcaggatgaggcgttccagggcctggcccatccgccgcgggtccacgtcggcgaagaccggggcggccgcgtccgcgacgatgctgaggcccttggcctcggccagcggtcggttcgccgcggccgaggtgcgggccagcacggccaggtcggccggcacccggtggaactcccggctctccgcgttcacctgtgcggccagcagcatgtcgtcgaccagggcgagcagccggtcggagttgcgctggacgcgctgcaggaagccgtcccggttggccgtgggcagctccgggtcgccgagcatctcgaggtagccgtggatcgaggtgagcggggtgcggaactcgtggttgacccgggcgatgaactcgtccttgatctgctcggcggtctgcacccgctggtgcagggcgtgcacgtcccgggcgtatttgcgcagctccagctgggtgaccacgtgccgggccaggacccgcaggccgtgccgctgggcgtcggtgagccggccgggctcggggtcggcgacgcagagcgtgccgagcggtttgccgagcgggctgatcagcggcgcgccggcgtagaaccggatgtgcggcgcgccggtcaccgtcgggcaggcggcgaagcgggggtcccggcgggcgtcgcagacctgcagaacgtcctcgtcgtacatggcgtgcgagcagatggagccggcccgcgggccctcgcacagatcggtgccgtaccgggccttgaaccactgccggtcggcgtcgatcaggctgatcagggcgatcggtttgtcgcagagctgggcggccagcatcacgatgtcgtcgaagtcgtgctcggcctcggtgtccagcacctcgtaggcttgcagggcggcgaggcggtcccgctcgatgtcgccgacgtactgcgtggccgccatgagactccccctcgagacacacttcccttaccgctatcagtcggtcggccggcccggctgatgagtcctacctcgggtgcagggcggtcgcgccgggctgctgcgcccgcggcgactgcgtctgctgccactggttctccagggtgcgggcgtacgcggagcgcccggccggcagcgtgaacgtcatccgggtgccgctgccgtacgggttgggaatcgcctcgatggtgccgccgtgccgctccacgatccgtttgcagacggccagctccagtccggagccgccggtgccctcgccgcggtggaagttggtgaagaccgcctggctcagcccggccgggatgccgcggccgttgtccaggatgtcgatgcgcagcatgccgttcggcgcgggctgggcggagacgccgatctgcggcgggacgccgggcatcgccgtctccagggcatggtcgatcagattctccagcagttgccgggtgagcaccgggtcggcctcgaccgcgtccagcgggccgaaggcgaactgcggtggcgtggtgccgttgctctccgcctggtcgtaccggctgttggcgatgtcggtgagcagcaactgcaggttgatcgtggtgggcatcagcttgccgtcgcgggcggcggtgtaggcgagcagcccgttgaggaaggtgcgcatccgggccgcggcccgctggatccggctgacccgctcggccggcttgtatccggcgagttccgcctccagcacctcggcccagccctcgatcgtggtcagcgggttgagcaggtcgtgcgcgaccactccggcgaacgacatcagctcgtcgcggtgccgacggtccgcggtgacgtcgtggaagaccaccaccacgtgctgcgggccgccggagccggccagccgggccacattgaaccggacgatccggccctccgggacggcggcgttgcggatcagcacgtccatcggctgcacgtcctcgccggccagcgcccgctggtagggcagctcggcgtcggccagcggggcgccgtccgggtggaagaagccgtagtcgctgcccagcgccgagcccgcggtgacctggctggtgctgcccagcaggcggccggcggccgggttgcgcagcaccaggtggccggtctggtcgaggatggccaggccctcggtcatcgagttgacgatcgtggtcatcaggccggccttctcggtggcctcgtgctcgctggcgcgcagccgttcgatcagcgcggtccgctcgtcccggctgaacgccagggccagcccgaccagggccagcacggcgatgtagagctggacgatcaggccgggcacgcccgggtcggtggtccgcatcagcgcgtacgggccgtggccgtgcagggtgaacaccgcggccgtggtgccgaagagcatgacgtgcccgatcaccagcacggtgggcagccgcagcgccacccagacggtgatggccatcagcgcgaagccaatcggcagggtctcgttgaccgagaagacgtagaagtaggcgcccgccgagagcgcgcagacgatcaccgtctccggccaggcgtcccggtcgagccgcaggtcggccagccggcgcgcggccgcgccgaagagcagcacgctgaccacgtcgcggaccagccacatcgcgatcgaggtgggcgcgtagtcgtgggtgaggaactgctcgccgaggccgccgatcgccgcaccggcgaggccggcgaacaccgccatgatcagcacccgcagcagatcgcgcagcgtggtcatgggccgggcgccgccgcgctcggcgaccggcgcccagagcccgggcagccagcgggccgcggcgcccgcgaagatcagcgcctcgatcatcgcggacaggccgtgcaccagcgccacccgcaggtcggcgccggcggcggccagcgccagcgtggtgagcccgaacagcacgccggcgtcggcccaccgccgcaccgggtcggtgcggctgatcagccagaccgcggcgaccgcggtggccggccagaccaccggcagagcccccggcatgccgagcacgctgagctggccggcaccgaccgccaccaggtagagcagcgcgaagcggacggtgctgggcagcatgcggaggttcatcggggtcgcctcgggtcggggtgggtgcactaaccacccgttcggcacggacggcgaatcgctgaacatcggggacgggagcacccgatcacctgatcggcgccgggtccgacgagctacgaggtggtcggctccagcagcggcggacgggcgccggaaggaccgcgccgatccggcgggccggccggcggctgccgaaggagcctcaatgacgccggccccgctccgataggggaagggtgagccggtggcgtgatcgaccgtggttccgggccaccgcgctcagtgcgctggtggccctggccggctgcgccgggtcgctgggcgtcggcacggtgctgcgccgcaacgagaaggccaccaccgacgtgcagatggaccggcgcacggcggctgcggtcgccgcggtccaggccgagacccggcggtacgtcgacacgctgcgcaccaccgcggcctcggtcggggcccagcagaccctgcaagccgacgagtacgccgcgatcaccgccccgttgcactcgatgaaactggccggggccacctcgatcgccctggtcgtgccggccgccgccgaccaggtggcccgagtccagcagacctggcgcgaccgcggcgccaccggcctgaccctgcaccccggcccgagcgccgaccacgacttctcggttctggtcgccgagctggacgggcgcagcggcacgaccggcatcgacctgatgcgggccgccgcgccggccgccgccctcgccgagtcccggcgcacccggcagatcgccgtctccgacacctaccagctgctggtcgaccagagcctgccaccggagcggcggcagaactcgttcgtcctggccgcacccgtctaccgcggaatccagcaggacttcctcggctggctcctgctcggcgtgcgcggccaggacttcatgggcgccaccctgaacgcggccgggccgggcctggccgacctgcggctcaccgcgaaccgcgccgacggccagccggtcaccgtcgccgccatgcggcacggtgccggcgacgacctgcggcgggtggtggacatcccggtcgccgactcgacctggacgttgcacgtcaccgggtcgcgccgcggcctccccggtgccggcaacgccctgccggccgcggtgaccggcgccggcctgctgctcagcctgctgctcacggtgctgatctgggtgctggtcaccggccgggaacgcgcccggctgacggtccggtcgaagaccgccgagctggtcaccgaacaggccgaggtgaaccggcaggccgggctgctgcgggcggtgctggacgggatcagcgacggggtcggcgtggtcggcccggacggcgcgttcctgctgcacaacccggcggcccgggagatcctgggacgcgacgaggaggacaccgacggcgccggcagctggcaggagcacttcgggctgttccggccggacgggaccacccccttcccgaccgatgacatgccgctggtccaggccctcgccggggaacgcgtcgatcaggtcgagatggtcgtccgcaacgccgcgcacccggacgggcggatgatcagcgtgtccgcgcggccggtggagacgggcgaggggcagcggggcgcggtcgcggtgttccacgacatcaccgaacgcaaacgggtggagaccgaactgcgcggcttcgccggagtggtcgcgcacgacctgaaggccccgctcaccatcgtcaccgcctacgccgacctggtctccgacgccctcgacgacctggccgcgggcgccggcgtgccgaccctggagcaggcccgccacggcaccgccaaggtgctgcacggcgcgggccggatgcagcggctgatcaccgagctgctggactacaccgcggcccgcgacgccaccctgcgcgtcgaacgtctcagcctgcgcgccctggtcgacgacgtggtgaccacccgtaccgacgcccccgaccaggaggcggacgcccggccggacgtgttcgtcggcccgctgcccgacgtcgaggcggacccggtgctgctgcgccaggtggtcgacaacctggtcggcaacgccatcaagtacaccccgccgggccgggcggcgcgcatcgacatcaccgcgcgcaccggcgcggacggcgaggtccgggtgcgcatcgccgaccggggcatcggcatcccggacggcgagcacgccgccgtcttcggcaccttccaccgggccagcaacggggccgcccatccgggcaccggtctcggcctggccatctgccgccggatcgtggagcgccacggcggccacatcgaagccgccccgaatcccggcggtggcaccgtcttcaccttcaccctgcccgccacaccgccgggcgagccgtcccggacgaccccggcccgtgcatcaatcccgaccggatagctcttgcctgttcacgtgcacatgtcctagatcaccttgttcgcccataggatttctgcgagcatcaccgccatgaatcgccgcagcctcctccagctcgccctcggcacgggcgccgcctccgtcctggccgcctgcgccgggcccggcggatcgtcgtcctcctcgtcgcacccctccggcggcgagctctccttcgcccactggcgggccgaggacaaggacgtgttcgagaagatcatcaaagatgccggtctggcggtccggcaggacatctccccgtcgaacgactaccagagcaccgcgctgcagaagatccgcggtggcagcgtcggcgacgcgttcaccgctttccggggtgcgcagttcctcgacatcgccaaggccggcatctggtccgacctgaccggcaagccgctggtgcagaagttcgcgcccaccctgatcaccgccggcgcgcgggacggcaagcagctcggcctgccgtaccagctggtcttcaacaccccgctggccaacaccgacctgctcgccaaggccggggtgaacgccgcgccgaaggactgggacgggttcctggcgctgctcgaagcgctcaagggcaagggcgtcacgccgatcgcctggccgggtggcgacgcggcgaacgccggtcaactgctcaacgtgatggtggtcaacaacgcgccgaccgacgatgcgctcggcaggatcgagaccggcgaggcgaaggtcaccgacgactggttcctcaccgtgctcaagcagtaccagcagctcaagccgtacttccagcagggcgcgacgggcaccggcgcggacgcggcgctggcactgttcgcgcagggtagggcgggtctgctggctaccgggtcgttccaggtgggcggggtccgcaagctcggcggcacgttcccgatcgacctgctcgcgccgatcaccaccaccgcggacaaggcgaggtacgagggcgtcttcaacgcgacgttcatcctcggcgtgaacaccgggtcggcccggcaggacgccgcgctggcctggctcacccatctgtccgacccggcggtcgccggcgtgtacgccaacggcacctcgcagcacgtcaccgtgcagggcgtcgagtacaccaacccggacctcaaggcgctcgcgccgtggctgaccaggaagaccacgctcgccccgcgcttccagttcaccaacctggacgtgcgcggcgccgtcgagaacgccgcgatccaggtggtcggcggcaagagcccggaggaggccgccgaggcggcccagaagatcgtcgatcagaagaagaagtagatgaccgtacgcaagatcgggctgctgctcttcgccctgcccgcccttgtcctgtacggcggcttcttcctgctgcccgccgtgcagggcctgcggtatgcgaccaccgactgggacgggttcagcccctcgttccggtcggtgggcgcggcgaacctcaccgccgtggtcgaccacgacgacctgttccgcaacgcgctcaccaacaacctcaagttcctgctggtcgtggtgctcgggcagaccgccctggcgctgctgctcgcggtgctgctggccgcccgcagccgcggctcgacctggttgcgggcgctgttcttcctgcccaccgtgctgtcgtcggtgtcggtggcgttcatctggaagttcgtctacgacccgaacttcgggctggtgaacaccctgctgagcgcggtgggactggatcgtttccgatcggcgttcctgggcgacgagggcaccgcgatcctctgggtggcggtcgcgcagatctggttccacgccgggcagatgatggtcatctacatcgccggactccatcagatccccgaggagctgtacgacgcggcgcgcaccgacggggccggccgctggcaagtcttccggcacgtcacctggccgatggtcggcccggccacggcgctggtcatcgcgtacaccaccattcagtccttcaaggccttcgacctgatcctcggtctggccggcaatccgccgcggtccgggctggatgtgctgagcacccggatctacagcacgttcgcgaattcgcagctcggatacgccgccgccgaatcgatcgttttcatggccgcgatcgcgctggtcaccatcctgcagaatcgggccgcgaaatgggtgcacgggtgacacgacgcctgatcctcaccacgtacgcgctgctgatcgtggtgcctctgctggtgatcgccggcggcagcctgaagaccagccgggaactgttcgactcgccgttcggcctgcccgcgcatcccaccctggccaactatgccaaggtgctggccgacggcgatctgctcggcgtgctcggcaacagtgtgctggtggccgctgtctcggtgccgctgaccctgttcctcggcagcctcgtcgcgtacgcggtggcccggctgccacgctggccgtcccgcgtgttgttcggcattttcgcgatcggtctcgccgtgccggcgcaggcggtgatgattccgcaatacgtgcagttcgaccggctcggcctgcggaacagcctgatcgggctgatgctggtcaacatcgtggtgaccctgccggtggcggtgttcatcctgaccggtttcctgcgcacgctgccggccgagttgtacgaggccgcggaattggacggggcgggactgtgggccacctaccgccggatcaccgtgccggtctcggcgccctcgctggccgccaccggcatcttcctggtcgtcatgcactggaacgatctgctgtatccgctgctgttcatcgacgacccggcgaaacgcaccctgccgctggcgctgctggatttccagggcgaatacctgaccgactatccgctgctgttcaccggggtgatggtggcgtcgctgccgatggtgctggcctacgcgttcctgcagcggcacttcgtcgcgggcatcaccgcgggcgcggtcaagggctgaccgaacggcccgggccccgcgccggtctccggcacgttcgtcgtggtggtgtccctccgcatgcggcaaccgggccgttcggctttccgggaaaccgggcggccgaagcgggacactgggggcatgtgcgattgcggccgccgatcccccggacgtccctgatgttcccgcgcccggtgggctagggttccgccgtgggattgctcgaccggttcgtctcgccccgacgccgattcgcggcgctggccgtccgcgtcgcccggcgcaccccgggggtcgaccgggcggtgagccgccccgacgacttctcgatcgcgatctaccgcaccggcgcgaccggcccggcccacctctatctggccaacatcttccgcgagacggaaggcgcgacgcccgccgaacgccgggaacgtctcgcgaaactggtccggatcatggcggctccgccgccgcaggacgattgggagacggtacgcccgaaactccgcccggtgctgcgcccggtcacgttcgggtcggcgggcccgccggggatgcgtccacccatctcccgagccgccctgccgtacctgaaggaactggtcgtggtcgaccagccggaagcgatggcgtacgtggtgcccgaccgggtcgacgagtggggcgtctccgccgaggaggtcttcacccaggcccgggagaacctggccgggatggcccgcacctccctcgaccagccgtggcccagcggccagccgctgatcagcatgctcgacgacggcgacgcctacttcacgtcgctgctgctcgcccccggctggctcgccgaggtcggcgaacgcctcggcggcccggtcctcgccttcgccccggacaacaacacgctgctgctctgcccgctgcccgagaccaccgcggaaccgttctacgccctggtcgaccaacatttcaaggaggccccacgcagcctgtccccggtcggctacgtggccggcccgcaggggcgcaccatcgcctacaccccacccctcggccacccgcaccacctctccgcccgccgcgcggagatggtcctcgccctcaccgaataccagggccagaccaactggctcgccgagcagtacgcccaggccggtgtcgacgtgcacatcggcggcctgctctccgccgaaccgatcggcggcctcccggaaaccatcgcggtctggacggccggggtcagcaccctgctccccaaagccgacgccatcgtcttcgtccacccggactcgggaccgcagttcagcgccccgtgggacgcggtcgcccgacgcgtcaccctggaagcggagcccctgctggccccggcccgctaccgcgtcgacgactggcccgccccggacatcctggcctccctccgccaggagatcgcctgacccgcatcccgcccgcccggcgtgctcgcgggcccgaccaggtttgtcgacggtgctgagcccgatggggtgggggcggccggggttcggcagactggcgggcgagcggaggggaggccgagtggcgccgattgatgaggaagaagccgggctacgggtcggggcgccggcggatcatgcggcggggcttgcggcggtgcggctcagtctgaccgatgcggtgcgcaagatgggtgtgggcaaggcggtccgcaaccttcgtacgctcaatcaggtcgacggtttcgactgtatgagttgtgcgtggccggatcctcaggggcatcggcatgcggcggagttctgtgagaacggggccaaggcggtctcctgggaggggcagcgggagacggtcgggccggagttcttcgcggcgcactcgatcgacgacctgagcgggcggagcgatcactggctggagaagcagggccggctgacgcatccgatggtgcgacgcgagggtgcgacgcactatgcgccgatctcctgggacgatgcgttcgcgctgatcggcgccgaattccggaagctgagcgacccgaacgaggccgtcttctacacctcggggcgggccagcaacgaagcggcgttcgtctaccagttgttcgcgcgggcggtggggaccaacaatctgccggactgctcgaacatgtgccacgagtcgaccgggacggcgctgtcgcggaccatcgggatcggcaaggggtcggtcaccctcgaagatctgcaccgggcggatctgatcgtggtctccgggcagaatccgggcaccaaccatccgcggatgctgaccgccctggagatcgccaaacgggacggcgcccggattctggcgatcaatccgctgccggaggcggggctgctgcgcttcgacaatccgcagaaggcgcgcgggctggccggttcggggaccgcgctggcggaccggctgctgcgcatccggtccaacggcgatctggcactctggcaggcgatcggcagcctgctgctgcggcgcggggtggccgatcgggagttcatcgagtcgtcgaccgtcgggttcgacgcgtgggcgcggcacgtggccgccgtggaccgggacgcggtgctgacggcgaccgggttgacctgggccgagatcgaggccgcggcggacatgctggcgtcggcgacacggatcgtgcactgctgggcgatgggcatcacgcagcatcgcaacgcggtggcgacgatcaaggagttcgtcaacgtggccctgctgcagggcatgatcggcaagccgggcgccggactgtgcccggtgcgcgggcactccaacgtacagggcgaccgcagcatggggatctgggagaagccgccggcggcgttcctggaccggctgcgcgacgagttcggcttcgagccgccccgcgagcacggggtggacgcggccgatgcggtgcgggtgttccgggacgggcgggcgaagatcttcctggcgctgggcggcaacttcgtggccgcgatgtcggacaccgaggtgaccgcggccgcgatgcgcaacgccgcgctgaccgtgcagatctccaccaagctcaaccgcagccacctggacgccgggcggaccgcgctgatcctgcccacgctgggccgcaccgagcaggaccacaccggcgggcgggtgcagcggatcaccgtggaggactcgatgtccgcggtgcacgcctcccgcggccggtcggcgccggccgggccgctgctgcgctccgaggtcgacatcgtctgcgggatcgccgcggccacgctcggcgaccggcacggcatcccgtgggcgtcgttcgccgaggactacgggcggatccgggaacggatcgggcgggtcgtgccgggctgcgacgactacgcgcaccgggtcgacaacggcggcttcacgatgccgcacccgccgcgcgacgagcgccgcttccccaccccggagggccgggcggtgttcacggtcagcccgctgcaggtgatgagcgtgcccgcggggcggctggtgctgcagacgctgcgcagccacgaccagttcaacaccacgatctacgggctggacgaccggtaccggggcatcagttcggggcggcgcgtcgtcttcatcagcgcggccgacctggccgaactcggcttcgccgacggtgaccgggtggacctggtctccgagtgggacgacggcgagcggcgagccgagcagttccggctcgtcgagtacgacacgccgaagggctgcgtggccgcctactacccggagacgaatccgctggtcccgctcgactcacaggccgaggagagcggcacacccacctcgaagtgggtgatcgtgcgcctggaacgccggtgaacccggccgcggccggctgggcggagacggcggcagcccgggtcgtcgcctgggcgcgcaccctgccggcggggccggcggggcggcgggtgctggtgatcgagggccggtccgggtccggcaagacgacgctggcggtcgcggtcgcggcgcggctcccggcgccgatcatccacatggatcagctgtacgcgggatgggacggcctggcggccggcgtggaggcgctgcgtgaccgggtgctggagccgctcgcccggggccggccggcggtgtggcggcagtgggactgggcggccggccgctacaccaccgaacaccgggtgccggacggggactggctgatcgtcgagggggtcggcgccggcgcgaccggctgcccgatcgccgggacggtgtggctggacagtccggacgacctgcgccgggagcgggcgctggcccgtgacggggacctttacgcgccgcactgggaacgctgggcgcggcaggaggagaagcttcccgacgtgcgcgggcaagccggcctgatcatcgcgaacggggcatgatctgaggcatgacggagcagcggatcggggtcagcggggcgaccgggcaactcggcgggcgggtggctcggcggctcgccgacctcggcgtaccgcagcggtcgctcgtgcgggacgtgtcccgcgcgccacgactgcctctcgccgaggccgccgcggcgccgttccacgaccgggacgcgtgccgggcggcgatggccgggctgcggaccgtgctgatggtgtcggcgtccgagacgccggaccgggtggtgcagcaccggacgttcgtggacgccgcggccgaggccggagtggagcatctggtgtacatctcgttctacggggcggccccggaggcgacgttcacgctggcgcgcgatcactgggcgaccgagcggcacattctcgggtccgggatggcggccaccttcctgcgggacaacctgtacgcggacttcctgccgatgctggccggcgaggatcgcgtgatccgcgggccggccggggacggacgggtcgccgccgtcgcgcaggacgacatcgcggacgccgcggtggcggtactgcgcgacccgggacgacacgcgggacgggtgtactcgctgaccgggccggaggcgttgagcctcgccgaggtcgcggagatcgtcggggcccgctatcacccggagaccatcgacgaggcgtacgcgtcgcgggccggctacggggcgccgcagtggcaggtcgacgcgtgggtgtcgacgtacaccgcgatcgcggccggcgacctcgccggggtcaccaccgacgtggcggagttgatcgggcgggcgccgatcacggtggcggaacttctggcccggccccgtcgatgaggcgcagccgcctctcggcgtgcgcgacgaactcccggacgccccggtcgcgcccgctgcggcgcaggtcggtcaagacctcccggagcaggtgtgcgccgcgacgcgaccggacccggtcccaccggtcgagcaccgtgcgtccggccacgcaggcctgctccagctcaccgctgatcacgtgcccaccggcgaggtagatgccctcgtagagggcggcccgcgggtgcggatggtccggttcgagcagggtcggtggacgcagcagcgagatcccccggcggaccagcgtccgggcgctggcccggcggccccgggcgcgttcgtcccgggccagctgcagcagagtccgggcagccatcggcccggccgtgtcggcggccacccgtcgcacccattccggctcgtccccgccgggggtcgcggcgatccatccggcagcctggtccgccgtccggcacgccgagcgggtgtcgccggcgagggcctgcgcgtacgcgagctgtcccgcggcgaacgccccggtggccctggtaccggcggctgcggcgagggccgcctccccgatggccaccgcatcggcgtgacgcccctgcagggccatgttggccgagaggtctcgcaggaggtgcgccaggagccggcggctgccgccctcgtgggcggcgcgcaggccggtgaccaggtagcgccgggattcccggtgccggtcggcgtcaacggccagccacgcggcgagctgcgccaactccgccaggacgagcagcagccgccggttcagcccgtcgctgcggcccccttgcccgaggagcagccgcgtcgcctggaactgcgccgccacgtagccgagcgcgtccaggccctcggcccccgcggcagcctcgcgcagcgcgtcgacgccccgctcggccgaccgcaccagctcgacgccggagccgtgctcgcgggctcgggacaacgggcccggttcccggcacaggtattctcgcgcgacgtcgggaagccgctcgccgtctgacgccgcccggtcgaggatgtccaggagtccgcggctcgccgcctccggcgagtccgatgccctcgtccacaacgcgtcggtggcgatcggccggcccagcgcctcggcgatgacccgggccgcgtattccgccaccggcggatagggcacccgcccgcggtcgcgccagtggtacggcgccgactcggagatggtgccggggccgtaggcggcgttgatccgccgggccagggtccggggactccagcggagctcggcgaggcaccgggcgagcacctcgttggacggtcgtgtcctgaccatcgtcgaaggttaacaaccttgacgggatagacgtatggctatggattacgggcttggcttgaatccgggagggaaggcacgaacccccacctgaaagggcacccgatggatcacgaccaccacgacgacatcttcgaccgcggcctccagttcgacctgaagacgctgctgggccgcaggcggatgctcggcctcgccgccggcgtcggactcgccggtctggcggccgccactcccgcgttcgcgaaggcgtcggacgactccccgctcgccgcggacgccgccgcctgccggaccattcccacggagaccggcgggccgttccccggcgacggcacgaacggtccgaacatcctcaccaggagcggcatcgtccgcagtgacctgcgcaccagtttcgacaccgggtccgccaccgccggcggcgtcaccctgaccctgcgcctcacggtgctgtcggccgccacctgcgccccgtacgacgcggccgcggtctacctctggggatgcgaccgggagggccggtactcgatgtactccgccggtgtcacccaggagaactactgccggggtgtacaggcggccggctccagcggccagctgacgttcaccacgatctttcccggctgctacccgggccgctggccgcacctgcacttcgaggtctacccgagcctggcccgggccacctcggcgagcgggaaactcaagacctcgcagctggcgttcccggccgacgtctgccgcaccgtctaccagagcgccggctatcaggccagcatccccaacctcgcccgggtctcgctgtccaccgacggggtcttccgggacggatacagccagcagatggtcaccatctcgggcagcccgcagtccggatacctcgcgagcctgacgatcaccgtgtgatccgcggtgcggtgtccgtccggttcccgccggggcgaaactccgggcggacaggcgcacacgaggagcggcccgggtcggatgcccgggccgctaccgccggatcagggccgcgaggcggtcaccaccgcgtcccggccggcctccttggcgcgatagagcgccgcatcggcgtggcgcaacatctcgtccggatcggtcactccggtgccgtcggcgaccccgatcgagatgcgcaccgcgagcccgggggtgagctgctgccacggatggcggcgtaccgcctcgagcaggcggtggcaggcccggagggcgccctccacggtgaggccgggcatgatgatcacgaactcgtcaccgccgagccgggccggcaggtcgatgacccgcaggtgatccgccatcagccggctcaacgcgaccaggacacggtcacccacctcgtgcccgtacccgtcattgacgctcttgaatctatccacgtcgaagacggcgatggcgaccggcggtgcgtcgtaccggtggttgcgttcggccagcgcggtgaggtgctcggtcacccgccggcggttcgcgatgccggtcagcgggtcggtccggctcaggtgcagcacctcttcgttgagccgctggagatcggccatctggccggcgagcgtcgcccgggcctgctccagttcggcgatgatcgcggcctgcgcctcggcctgccggcggtagcgttccgcctcccgctgcgcctgcgcgacctcgaaccgcacccgaagagcctgggtgcggcgttcctgcgcaccgcgcgtggcggcgtcggcgagctcccggcagcgaaggaggtggtcgtaggccccggcgtcgtcaccggtcgcgtgcagcacctcggcgagcagtgactcggccagcgcctcggagcgctgcgaacgcagcccgccggccagggcgatgacgcgctccagcgtttcgcgagccgcatcccagcgcatcgaggggttcagcaccgagcgcaccaggaccaggagccgatgcatctcatacccctggttggcgatggcgccgtcgggcagcctgttgtgcgcccccgcccggccgagccaccgctcggcgtcgtccaggcggttcaggtccgccaggacgtgcgcgtacgccgtcatcgcccgttgtgcgtccaccggcatccccgcgtcgccgaagagccgcagggcgcgctcgccggtctcggcggcggtgaccggatcaccgatctcacgctgaccatccgccatcatggcgagcatcgtcgcggcgccgctcgcgtcggcacaggccaggaacagaccgtgtgcctgttccaacagctcgagcgcctgtcgccggtcgcccatctccgccaggagcgtcgcgaccaggctgagcacccggccctcaccgtaggcatcgccggacttccggtacgcgtccagcgcctcgtacccgtgctccatcgactccgggacgcaatcgagaaggtgcagacacatcgccgccgtgtgatgcgcctgcgcggtcgccagcgggtcgccgagaacaacggcctcgccgatcaggctcagcgccgtggacagggcgtccaccggttggccgtggcgggcggtgaactccgtgaccatcgcggtgcagcgcacgcgggcgacctcgtcacccagcgcggtggcccgctcgatcccgtcacgggcgagcgccacccgacgctgcggatcccgcaccaggcgagcggccctgtcgacgagcatcgccagctcaccggcggcggtgaggggagtcttcacgtccgcattcatcggcagtcccgcggctcaggtgagccctccggaagacggtggcggttccggaccgccggcgcccgggtgcttccgtcggcagacccgggcacggcggatgacggtgtcgtcagatcggctgctggagcagcgcgccgtaacggacgaccgggtcgcccggaccggtggcgagcacggcctcggcgccggccccgcccggtggctgccacgcgaatccgctcgcggtttccgcgcccgtacgcctgacgacgggcacgatcgtatcgccctaccccatcgcggctccccaaccgggaaaatccagttttttcccccgatcgggggaagtgatcgtggtttccgtggtcagctgtcccggacatggcagcaaccttaggaagggacacaatgcgtaaaacgacacggagcctgaccctcgccggagcgggaatcctggccgccgcactggcctcacccgcccaggcgtcgccggtgaacgtgccggacgccggcggcgcatcggggcaggcccagcgctccgacgacgtggccggcttctacaacacccgggccgcctgcgaggagatcagccggatcgggtccgcgatcggggcgtgggatgcccccgactgcaggacggcattccacggcgtacggcgaatattcgtcctgatcgtggacttcaacgatgatgggcagccggtcccggccggcgggccggggaccggcttcccgggcggggggcagcaagggccgggtgcggggcccggcggcggccagcaaggacccggtgcctagctagctaggtccgccagcgaaccgggcacagccgcccagcccaccccgtccgccagcgaaccgggcacggccggtgagccgggaaccgcgccgggcgccgggcagccgggaaccgcgccggcctcgtcggtgagcatcggcgtgcagtccgcggccaatggttcggcgaccggcaccacgaccggcaccacgctgagcggcacggcgaccggcacggcgacgatcggcaccgggccgatcgcccgccgcgcgctctgaccttcgggaaggcggccgcccgcggttcccggacggccgctttccgcgaaagcccggaaccacccccgaccgccgtggtcagctggaattttccaggcgcagcagccgaggaggggatgacatgagaacggcgacgaaactggccgtgatcggcggcggggcgctcaccgcgctcgcgatgacggcactgccggcccaggccggcggaaagccggacaccgggtcggcctgtgccgacttcaaccggatcggggccgagaccggcctgtggggccgttacgactgcgcggactggcgggtcgaccacagcgaccgggtgctgatcgtgcgacaccacggtgcggccacggtccgggtcgacgaccgctggccggtcatcgacatcggccgggatctgccgcgggcgggcgacctgccccaggtgatcaacatcaacgggccgtcgggcgcctacaccattccggtacggccaccccggtaggccgggggcggccggggcgtgctccccggccgccgccacccgggccctcagccgccggccatggcgcccaccaccatgaagggttcctgtccggcggcgacgcgctccggcaggggcgcgtccggcggctcgttcgacaggtcctcctcgcaggcgaagaagcggaccagcggccgccgtctgccgctcacccggtcccggatggtcccggtcagcatcgggtagtcgcgttccaccgcgtccagcaccgcccgctgggtgaccgtcccgctgacgctcaccgtgacctctttcccgactccggcgagggtccgcaggtgcaccggcaggatcacccggatcacggcagcacctggacttcgacggagagcaccggcggcaggtcgcgcacgatcgcggcccaggtgtcgccgctgtcggccgacgcgtacacctggccgccgctcgtcccgaagtagacgccgcagtcgtcgagcgtgtcgaccgccatggcgtcccgcagcacgttgacgtagcagtgttcctggggcagtcccgcggtcagcggctcccaccgctctcccccggtccggctgcggtagacacgcagccggccgtccatcacgtagtgcagcgagtcgctggtgatcgggacgacgtagatcgtctccggttcgtgggcgtgtaccgcgatcgggaagccgaagtcggtgggcaggtttccgctgatctcgcgccagcggccgccggcgtcgtcggtgcgcatcacgtcccagtgcttctgcatgtacagggtgtcgggccgggacgggtgcagggcgagccggtggacgcagtggccgacctcggcgtcctcgtcgggcaggccgtcggagcggagcccggcgttgatcggctgccaggtggtgccgccgtcgtcggtgcggaaggcgccggcggcggagatcgcgacgtacatccgctgcgggtcggtggggtgcagcaggatggtgtgcaggcacatgccgccggcgccgggctgccaggtgggaccggtggagtgctggcgcagcgcggtcagctccgcccagttccggccgccgtcggtggaccggtagagcgcggcgtcctcggctccggcgtagacggtgtccgcttcggtgcgggacggttcgagatgccagatccgtttgaattcccacggtcggggggtgccgtcataccagaggtggtcgccgaccggcggggtgtaggtgaagtcgttgccggccggctcccaggtgcggccgccgtcgtcggagcgctggatcacctggccgaaccagccggacgactgggacgcgtacaggcggtcgggggcgaccggcgagccgttgaggtggtagatctcccagcccgcgaagtgcgggccgtcgacccgccagtccttgcgcgtcccgtccgaggtcaggatgaacgcgcctttgcgtgtgccaaccagcagccgaatatgggtcattcgtccaagctagccctgcagggcccgggccatctccgcctgctcggcgagtacctcgttcatccggatctgcacggcgtccatcttgccgatcgtctcgctggtggtgtggatgccggtggccaccgtctccgcgctggcctggatgccggcgatctgttcggccaccttctgggtcgcctcggcggtctcccgggcgagttccttgacctccccggcgacgaccgcgaagcccttgccggactcgccggcgcgggccgcctcgatggtggcgttgagggccagcaggttggtctgctcggcgatcgactcgatgatcttgatgacgtcgccgatcgcggcggacgcctggccgagcgcggccacctcggtggtcatcgcggaggcccggctgaccgcctgttcggcgaccgcggtggcgtcgccgctggcgttgcggagccggtcgacgctgtccagcagggcgcgcgcgttggcggccgagctctcgccggcccgcagcaccgcgagacgctggttgaccagctgctgcacgttgcgcagggcggccgcccgggattcggacagctcgatgtagtcgctggtgaagaagtccatggtgccgaccacccggtcaccgctcatgatcggaaagcagacgccggagcggaccccggcgcgcccggccgcgggagcccgcacgcagtcggtgagctcctgcaggtcgcggacgaagaccaggtcgcgggagcgccaggcgcggccggagagcccgaccccctcggcgaaggtggcggccagcgtgacccggcggaactcgtcgccggccgagccggactcgacctggaacttgagcacgttctcgtccgggtcgacctcccagtacgacccgtaggcccagccgaacgccgaccggaccgcgtccagggcggcgcgcagggcggtcgcgctgtcctgggccgcgccgagccggttgaccacggtggtgatcgcgttccggtcgtcggccgcctggcgcagctcggccgcggcgaccgcgctggtccgggcgcgttcggcgatccgggtgatggcgccgaacttctcccggcgggccgcgtccaggtgcagcgggctggccgagtagtactccagcacggcaagcacctcgctgcccctggtgaccggcagtgccaccccggccaccatcccggcgcgcatcgccgcctcgcagcgtcggcagtcgcggcagtcggcggggttctcggcgaccgccgcctggcgggtgcggaacgcctgcccgatcaggccggtgtcgccacgtgtcaccgtgccggcgccggccgcctgcacctgcccgctgatccggcccacctcgtgcagcaggcgcagctggccgccgtcggccagccagacggcgccgtagccgaagtcgtacgactcgaccgtgctggccaccgtgatccgccaggcggtgacgtcgtcgatcgccgcgtcgagagccaggatcagctcttcgagggcttcgacgtcgcgcggggtgggccgggagacttccggggccgtctgccgggatccgaacaaccgcacggtgttccacctctcgccgattagcgccgacatcctccccatcggcgcatcggccgggagatgtagtggaaacctccgggctggaagcggtatcccgtccccggctcggtcagcaggtgccgcggccgggccgggtcgtcccccggttcgcggggcagccgccctctgccggctcgtcgacgacggccggctcgccgagctcgaccacgacgccgtcctggcccgccgacgccgggcgccgcgcccaggtagattctcagctcgccgcggcccatgaggagagtcctcataatccgtctcgagggtgcgcgcggggagacctgccgacaccgcgcagacgcccggcccgtcgtttttgacgcgctgttcacgctggggcccggatccacgattcctgggagtgccgttcaggttcgctgggtaggttgactgactcgggcccggaactccggcgtccggggtcaggacccagcgaaggagttgatgtccgccgtgggcggatatgggtggcaagtcgtcctcgtcgtggtgctcgtgctgctcaacgcggctttctcgggcagcgagatggcgctgatctcactgcgcgagagtcagctgcagcgtctggagaagcagagccgttccggggcgaccctggcccggctggcccgggatccgaaccggttcctcgcgaccatccagatcgggatcaccctggccgggttcctggcctcggcggccgcggcggtctccctggcacagccgttgatcaagccgctcgggttcctgggggacgcggcaaagccggccgcgatcgtggtggtcaccatcgtgctgacgttcttcaccctggtcatcggggagctcgcgccgaaacggatcgcgatgcagcgggccgaggggtgggcgctgctggtggcccggccgctggacgtgctggcctcgctgtcgcgaccggtggtctggctgctcggcaaggcgaccgacctggcggtccgcggggccggcggggatccggacgccggccgtgaggaggtctccgccgaggagatccgcgacatggtggcccagcagcaggagttcaccccggagcagcggaccatcatcagcggggcgttcgagatcgccgaccggaccctgcgggagatcctggtgccacgccgcgacgtgctgatcctgccggccgaccagccggccccggagagcctgcggcggctggtcgagggcgggcattcacgggcgccggtgaccgggccgctcggcctcgacgacgtgctcggggtggtgcacctgcgcgacctgatcgggtcggacgggccggtgcgcgagcacatgttcaccccgctgttcctgcccgagacactgaagatcgccgacgcgctgcgccagctgcgcacccagcggcagcagttcgcgctggtcgtcgacgagcgcgggtcgatcgacgggatcgtcaccatggaggatctggtcgaggaggtggtcggcgagatctacgacgagaccgaccgggacgtgcagtcggtggtgcgcgaggaggacggcgcgatgctgctgcccggcaccttcccgatccacgacctgccggacatcggcgtggagatcgacgaggcggacgagggcgactacaccacggtggccgggctggtactggcccggctggggcacatcccgacggtgccgggcgaactggtggcgatcgacgggcacaccgccgaggtcgtggagatcaccggccgggcgatcacccggctgcggctgcgcccgctggaccaggagacggtcgacgcctgagcccggccggtttgccgggcggccgcacggggcagaatgccgcggtgctcacgatcatcgcgctcgcgctgctgggcgtggtgctcggtttcgccgtactgcgcccgcgcggcctgccggaggcggtcgccgcggtcccggccgccctgctctgtgtcgcgctagggctggtcccggccggtgccgccgtcgccgaggcccgcgagctgctgccgaccgtgctgttcctggccgccgtactggtcctggcgttcctcgccgaggagcacaacgtcttcgggtacgcgggtgccgtggtcgcccggatcggccggggccggccgggccgcctgctgaccgcggtcttcgcggtggccgcggtgaccaccgcggtgctcagcctggacgccaccgtggtgctgctcaccccggtggtgctgaccgtcgccgcgcgggccggggtgcggccccgcccgcacgtctatgcctgcgcgcacctggcgaactcggcgtcgctgctgctgccggtgtcgaacctgacgaatctgctggcgttcgcggccagcgggctgagcttcgccgggttcgcggcgctgatggcggccccgtggctggcggtgatcgccgtcgaatacctgatcttccggtggttcttcgcccgggacctggccggcaccgcgcagacccccggcgaccccggcccggccccgcgatacgccctgatcgtgctggccgtgaccctggccgggttcgccgccctgcagccgctcggcgtgcagcccgcctgggtcgccgcggccggcgcggcagccctggccgtgccgctgttgcgccgccgcatgatcggtgtgccggccctggtcgccgagaccaacccggcgttctgcgcgttcgtcctggcgctgggcgtcgtggtgctggcggtccgctcacacgggctcggcgaccggatcgacgcgctggtgccgcacgacgccggcctgtccgccctgctggcggtcgccgggctggccgcggtgctggcgaacgtgctgaacaatctgccggccaccctggtgctgctgccggccgccgcgcactcgcccggcctgctgctggcggtcctgatcggggtgaacgtggggccgaacctgacctacaccgggtcgctggccaccctgctctggcgacggatcctgcacgtgcgggacgcggcgccgcgtacccggcagttcctgttgctgggtctggccaccgtgccgttgtgcatgctcgccgcggtcctggcgctgtgggtggggttgcgggtcagcgcgctgtgacggcgcgcagggcgctcagcgtctcgcgcatcagcgcgcccaggtcgctgggctcgggccgggacacccactgtccgaaggcgacccgcagcgtcacgatgccgacctcggcggccagggtcgcctccgggtcgggcacgccgcgccggcgcagcccctcggcgagtgcggcgccgatccgggccatcttgatcagctcgcgttcgcgcagctcggggttcgcctcgacgaccgactgccgctgccgcgagtgcgggtggtcgcgcccgagccactcggccgccacctccagcgccgcctccacggcgcccagcgcgccggtcgccggcggcgcggcccgcaccgcctgggccagcccgtcctgcaactcctgcgacccggcgaacagcacctcccgcttgtcggcgaagtgccggaagaaggtccgcgcggtcaccccggcccgctgggcgatctcggccaccgtcgtctgctcgtagccgcgctcgacatacagctccagcgccgcctcccgcagccgcccgccggctcccggctcccatcgcaccatgcccgtgatcgtagtcatgtcacaggctgacatcacgtgcgctatggtcatgtcaccaagtgacatcacgtttcgtggaggcagtcatgcacgtcttcgtcaccggcgccagcggctggatcggctccgccaccgtcaccgacctcctgcgggccggccaccgggtcaccggcctggcccgctccgacgcggccgccgcccggatcgccgcgctcggcgccaccccgctgcgcggcgacatcgaggacctcgccggcctgcgcgccgcggccgccgccgcggagggtgtcgtccacctcggctactagctagctaggcttcgcgccgaccgtgcacggcgccggcgaccacggcttcctcgccaccctggtcaccatcgccacaaccaggcaggtcgcggcgtacgtcgagagcggcgccaaccgctggcccgccgtgcacgtcgaggacgccgccgccctggtccgtctcgccctcgaggccgccccggccggcaccgtcctgcacgccaccgccgagcagggcgtccccacccgcgacatcgccaccgccatcggcgcgggcctcggtctcccggtcgcctcgattccggcggaccgggccgacgagcacttcggctggatggcccgcttcttcacgatggacgctccgacctccagcgaggccacccagcagctgctgggctggaaacccaccggccccaccctgctggaggacctcagcgccggccactacttcgcctgaccggcccgcaccgcccgggcctcagcggtcggcgtcctgcaggaccttctgccaggtgatggtcttgccgaagatgtaggcggtggtggcgatgatggtggtgccggccagcagcaggaccgggccccacgccgtggcgttgtaggagcagacgtccttgagcggtgtcgtcggcagcgacagcgcccagaccagataggcggcggtggccgcggcgggttcgacgagcgggaccttgaagcgggcggtgggggcgacctgtttctggctgcggtaggccaggccgatggtcagcaggacggtggcgacggcgagcagcagcagccacacccagcgggaggtgaagtcggcctcgcactccgggtgcccgggcggggcggccacggtgccgagggccgcctggacggccaggtagaccgagatggtctcggtggggacgtacttgacgagttgggtgaggaccgagccggtgacgctggtgccggcggagaggcgggcggcgttctcaccggcggtcttggcgtcgtcgggcggggcacccttgaccatttcctcggcggtgacggcggccgcggtggcggcggccgccttcggggagacgcccggggtgccctgcaggcgcagggcgctgtcctcggccatcgatgacaggctcatgccggcatccttcgcacggtaacggtcagcagcacagatcggagcgggatcggcgggcggtgatacccgatgaagatcaggaaaacgaagcgagattaggcgtgaccggtatacgtgtcaatgaatgggacatgtccggtaggcgacctgatggataggaagatcgggcgattgacaccgtctccggccgcggtgttggattttcggcatgccgatcaaacggtacggcgttctgcgggccgccgtgatcgatcgaaggatcgagacctctgacactccgcattatcagattcagttgcgcgccggcggtatcgattatcgggccgcggtgaatgtgcgctcccagcagtcgccgccggaactgctctacctggcggtcgacgcgttcgcgcacccggttctcgaccagctgcgccggcttccggacggtttcaccgagctggagagccggtcgggtgggccggccctggactacatccggagcaatctgttccagcggccggacatgcgcccggtgccgaccgccgagccgggcccggagaatgatctcggcgatttcctcgaccaccatgtgcggcgggcactgggggatgccgacgcccgggcctacgttttcggtcaggcctgggggccggaggcgatcgaggacaagatcttccacttctcccccggcaacggtgtgcacgatgtgcacatgaaccagggcaacgagggccggttcgccggtgacgacggtgtctatcaggacggcgcgctgctgctgcagttcggtgacgcgtgggtggcgatcttcctggccttccagtcgcaggcctggcacaccgacgacatcaccggccacaagctcccggacgtgcccggccccgggccggcgtccaccgaccgccgggtgcgcatcgtcgcggcgctggccgatccggccggcccggccccggagcgggagacggtcaccctggtcaacgccgggccgtccgatcaggacctgtccggctgggcgctgctcgaccgcgccggcaaccggcaggcactgcggggcgcgttcccggccggcggcgccttgcaggtgacgctcaccgccccggtggcgctgggcaaccgcggcggcacgatcaccctgctcgacgcggccggcctcaaggtcgacggggtcgcctacacggccgaccaggccggccgggagggctggacgatcgtcttctagatgaagacgccgtccagcatcagatcgaccgagcgatcggcggccgcgcgcgcggccgccgcgtccgccgccgcctcggcgacgccctgcaccatggtgaacagcagggtcaggtcggcggggacgagatcggcgcggacgtagccgtgctcctgcgcgcgccgcagcggcccgccgagggcggcgagggcccgctgccggtaccggttctgggcggcgaccgacagccgccggatcagcacgaccaggccgcgcatggcgatctgggcgtgcagcaccgagcgcagcaggttccggaagtgctccgggtgggcgagcagcaccgaggcggcctcttccaggcgctccagctgatactcgatgaccgcggcgatgagcgtcgggcggtccgggaaatgccggtagagcgtggcctgtccgacgccggcccgccgggcgatctccggcatcagtgacaccgggtcgccctcggtgagcacctcgctggccgccaggacgatggccgcgcggttgcgctgggcgtcccggcggcgcgtagtcggggttccgtagagcaagcgtcccacccccttaccgaccagtcacgttaccggtcggtaacgagaatgtcatcaccttcactttctcggtacgggtgccgcgcgcttctcggtgggcggaccggtcaccatcgccggcggctgctcggcggacgagccggcggctcctcggcggacgagcgctagctagctagccccgccggccgccccggccggttacacctggtggcccgatccgaccggcttccagctcgccgtccccgccggctggaagccggcccggatgctcggcacggtcaccttcaccgacccgcacggcccgggcaccctgcgggtgagccgctggccgcacccgcccgccgacgtggccgccgccctgaccgccgaggaacgctcgatccggctgcccggttaccaccgcacccggatcgacgacaccgtctgggagtacacctggaccgacccggccgccggcccgatgcgcggcgtgcgccgggcggtgcccacgaccaccggcacctacgtcgtcgaatggcgcaccccacgcaaccaatgggcagctgacctgcccaaactcgcgattgtcctggagacgctcgactaggcagaatgtgcgtccatgtatgtcgggatcaccggggtgggcgcgtaccttccggagcgcgaggtcaccacggacgagctgcaggacggcgtggcccgctccggcggcatccgtctgcccggtggcctgttccgccggctcaccggcatccagcggcgccggatcgccgggcccgacgagtacgcgtcgacgctgggcgtgcacgccgcccgggccgcgctgcaccgggccgagctggacccgctcgacatcgacctgctgctgttcgcctcggcgtcgcgggacatggtcgagccggccaccgcgcacatcgtgcagaccgagctcggcagtcgcgcccacgcgctggacgtcaccaacgcctgcaacagcttcgtcaacgggatcgacatggcccgggcgatgatcctggccgggcgggcccggcgggtcctggtggtgaccggggagaccccgagccgggtgatgcgcggccgggtggacagcatcgaccaggcgcgccgctcgttcgccgggttcaccttcggcgacgccggcgcggccgtggtggtggagccggtggcgcgcggcgggatcctggacgtcgacaccgagacacagtcgcagcactgggcggtcggcggcatccccggcggcgggtcccggcatccgcgcggcgacgagcacacctacttcgccggggacgggcaccggctgcgcggcgtgttcgagaaggtcggggcgagcatcctggaccgggtgcgggcacggaccgggctggagctcaccgattacgccaaggtgctggtgcaccaggtgacgctgccctacctggaccggttcgtcgaggtcaccggggtgccccgggaccgcctggagatcaccgtggacggggtgggcaacgtggcgagcgcgaccctcggcgtacaactcgatctggtcttcgatgatctcgcccccggggagcgggtgctgctcatgggcctcggcggcggggtcagcatcatgaccatggtgtgggagcggtcgtgaccccgctctgggtcatcgtcccggcgttcgacgaggccgcccggatcggcgccaccctggacgccctcgccgcgcagaccgaccgcgacttcaccctgctggtcgtcgacaacgcctcgaccgacgccaccgccggcatcgcccgcgacttcgcccgccgggcccccttcccggtgcacgtgctcagcgaaccggagaagggcgtcggctgcgcggtcgacaccggcttccggcacgccatcgcggccggcgcccggatgctcgcccgcaccgacgccgactgcctgccccggcccggctggatcgccgccgcccgccgggcactcagcgccggcgacgtcctggtctgcggccggatcaccgcccggcacgacgaacacggaccgctcggacgcgccgccttcgccgggctcgtcggcctcgccgcggccttcggccggatccgcccggcgcaccgcggcgacgcctacctcgcgccgtaccggatgcacgccggcaacaacatggcgatcaccgcccggctgtacgaggcgtgcggcgggatgccgcgccgcccctcgccgaccgaccgcaccttcctcaaccgggtccgcgccaccaccgaccgcatcgtgcacagccgcgacatggtggtggagaactccacccggcggctgcgcgcctacggcgtgatccgcaccgcccgctggtatctcgaccgcggcagcggcccgctcaccccggacccgcggtgacccgtcatgctcgatgaactcgacgccggcctgcggcccggcgacgacaccacggcgttgctgcgccgccgccggatcacccgcggagacctcgccgacctacggctgcggtacgcggcggccctgcacgcccgcggcctgcgccccggcgacaccctcggcgtggcggtccgccccgggccgcgcgcgctggcggtcctgctcgccgcctaccggatcgggctgcggatcgccgtgctcgacccgtccgccggccccgacgtactgctcgcccgcctgagcctggcccgcccgtcgctgatcctggccgacgccgccgcccaggccgtcgccggctgctagctagctagcctggccctgcccgacctgtcccgactcgccccggtcgccaccgtcggccggcgactccccggatccgcgccggcgctggccccgggccacaccccgccaccggtcttcgacggcgacggcgacgcggtggtgatcttcacgtccggcaccaccaccagcccgcgcgcggtcgtgcacacccgggccgggctgggcgccgggatgcgcgcggtgaccgccctggtccggccacgcccgagggtaccggtcctcggcggcatgttcttcgtgatggtgcccgccctcgccggcggcgcgccggtcgccgtacccgcccgccggccccgcgacctggcccggcagatcaccgggttgtgcccgcaggccacctacctgaccccgccgcaactgcgcgccgccctcgacgccggggtgccgatgcgcggccgcgtctacagcggatcggcaccggtcaccgccaccctgctcaaccgggtccgggccgccggcgccgacgaggcctggtgtgtgtacgcgctgaccgaggtcttcccggccgccgccgtcgaagcggccgagaaggcggcccactccggcgacggcgacctggtcggcaccctgctccccggagtccgcgcccgcctcaccgaccggcgggaactccaactcgccggaaccggcgtctgcgaccgctacctcggcgccgaaccccacgcctgggtgtccaccggggacatcgcccgcctcgacggagaccgggtggtactcgccggccgggccaaggacatgatcctgcgacgcgccgagaacatctaccccggcctgtacgaaccgtccctgcacgtacccggcgtcgccctcgccgtcctcgtcggggtgccggccggcgacggcgacgaggaggtcgtggcgatcgtggaaaccgcgcccggagccgacgagacagcggtacgcgccgccctgcgcgaacccctgcaccggatgggatcggcccgccccgaccggatcgtcttcgcgacggtgccgctcaccgggcgctcccggaaacccgaccgggccgcggcggcggcgatgtgccgatgagaaccctcgcggtgatcgtgcccgcctacaacgagagcacctcgatccgggccactctggcggcgctggccgcccagaccgaccgggacttcaccctggtcgtggtcgacaacgcgtcgaccgacgacacggtggccgtggtccgcgccttcccgacgccgttcccggtcgagatcgtcaccgagccggaacggggcgccgggaccgccgcggacaccggcttccggcatgccatcgcgaacggggccaccctgctgtcccgcaccgacgccgactgccggccggccgccgactgggtggcgaccgcgcgacgccacctgaccgcgggagccgacctggtgtgcgggcgcagcaccccccgccgcgacgaacagccgaccctcgccgagcggtacgtcttcccggcggcggtccgggcggcggcactctacgggagataccggaaggcacaccggcaggccggattccgtacgccgtacgtactgatccacggccacaacctggccctgaccgccgacctgtaccagcgctgcgggggcaccgcccgggaagccctcgaagccggatccgaagacgtcaccctgctcaaccgggcccgccggcacacctcccgcatcgtgcgcgccgaagacctcgtggtcgaggccagcctgcgccggctgcgagcatggggcgcgcgccggaccctgctctggtactgggaccggcggtggcgcccggacaccaccgcggaggtgcacgtccgatgagccgacgcgaccgacgggtctacctgtccagccacccgctgctgttcgcgctgctcgccgccacccgcggccgcggggtgcgccggatcggcgcgacggtgctggcgcactccaccacggcgttccgggacggcctgacccgggtgccactcgaccggaccgcggcgggaaccaccggcggggcggccggcgaactcaccggcggcgatctgttgttcaaccaggacggcagcgagcatcgaggggcccggcgcgggctggcactcggcgcgggcgaggtggaccggctgcggccggtctggaacgcggtgctggaccacgggctcgcaccgctggccggcggagggacgatcgaactcgtcgagctggccgccgagatggcgggagcgacggcggcggcgctgctgcgggtcgacctagctagctagtcgccaccgagcgcctgaccggcctgctggcggccgccccgcccgcggtctcgccgtcggtcggctcttcgtccgccgttccgggcgccactccggctgcctttccggccgacacttccaccgccgttccggacgccactccggccgcctttccggccgacacttccaccgccgttccgggcgccaccccggccgcttttccggccggcgcctccaccgcctttccgggggccgcttcgctgtccggcgccgcgtcggctcccgccgcctccggggaggtggcgctgtcggcgatgctcgcggtggcggcgatcaacaccacggtcgcggcagtcccccgggcggcggcctggtgcgccgactcggacctgtggcactacgccgaaacccacctcgaagcgctgacgtcggaaatgctccgggtgaccgcgccgaccccgctgctgccccgggtcgccgcggcggacggcgtgatcgacggctgcccggtgcgggccggcgaccgcctgatcctggtcacccggcacgccgtcgacgcgcaccgccgccaaccgtgcccggccgacccggcgccggcgcagaccgcgcagctggtcttcggcaccggaccgcacgcctgccccggggcgcggctggcccgcctgcagctcagcgacgccctgcaggccctggccaggttccggccgcgggtggtcagcgctcgcgtcgaccggcgaagcgctctccccgcctggtcccgtctcaccctggcgcccacccgatgaccgacccggcgggctggaacggacgcaccggcacgcccccggcggccgggaacgaacccaccggcacacgcgtagcgggcggggacggagccgccggcacgcgcccggcggcctcgaacggacttgccggcacgcgcgtggcggtcaccggcgccagcggattctgcggctcggcggtggcccgcgccgccgcggccgccggcgccgacgtcatctgtctcggccgccgccccggcccggtcggcgagcaccgcttctgggacgccacccgcaccctgcccgacctgaccggcgccgacctcatcctgcacctggccgccgcggtcggcgacccgccccccggccgggtcgcggcggccgccttccacgcggtcaacgtggacggcaccgcccggctcctggacgccgccgccggccgtcccctggtctgggtgagcagcgccagcgtgtacacccccagcccccacccgatccgggaggaccaaccactgggcgggctcaccgcgtacggccgatcgaaagccgccggcgaacgcctcgcctcggccggcggcgccgtgatcctgcggccccgagcggtctacggcccgggcgacccgcacctgctgccccggctgcgccgcgccgtgcgcggcggccgggtgctgatgccgggcccggacattccgctcagcctgaccgctgtggagaatctggccgacgcctgcctggtcgcacaccggtggcccgccggcgcctacaacgtcgccgacgcggaaccgtaccgccgcgacgccatcatcgctgccgcctgcggggtgccggtccagcacgttccgctcggcgcggcccgcgcggccgccaccgtcgcgacggcgatctcccgcctgaccgggggcgaagccgccctttcccggtacgccctggaacaactgaccaccccggtcgtcctgaacatctcccgagcgctgtcccagggctggcgaccggcccgcaccttcgccgacttcctgcgatgaaccacccgccgcgagaagctccgcccgcgcccgcgcctcgcgcgtccagctccatgtcgtcgcgcccgcgcctcacatgtcccgccacgtcgtcacggccccgcctcgcgcgtcccgcctcacctcacggccgccaggcatcctaggaagataggatccatcctccctctccggcggcccacccccacgcctcaccctgccgccatcaggaaacggcgggtttcggaaatccgcgaggttttccaacgcttgggacacctccgggaaacccgctgttccgttattgacacccgcgatcacgtcggcatgatggtcacctgacccccgccttcccccgaggagtcgtcatgatcccgacgagcgccgcggaggccgagcccgtcggccgccgccggggccgcccgccggacccccatgcccgttcccgcattctcaccgccgccgagaccctgctcgacgaggccggctatctgaacgtcacgatcgacgaggtcgccacccgggccggtgtctcgaagaagaccgtctatcgcttctggccgcacaaaccggccctgatcagcgatctgatcgtcgagcgttccgcggtcctgccggtgccggacaccggtgacacccgccgcgagctggccaccctgttcggcatgatcatcgagtacctgaccgccggtcacggccgcacgatggccctgctggtcgccgccacgcacgacgatccggccaccctcacccgcctccgcgagcaggtggtcgccccgcgccgggacatcgcccgcaatgtcctgcagcggggcatcgcccgtggtgatctcccggccgacgtcgacgtcgacgcgctgctggatctgtggcatggcctggtcgcctaccggatcagcgggcgccccgcggccctgcaccggcacaccgtcgaccagttggtcgatctggcgttgaccggccacgtcccgcgcctgccgcaaacctgacccgccggcccgggccgccgcccacctccgggtgcgctgagcttcaccagacgattgcggcgtacgacgtcagccccgtcccgcgatgtgacatccctgatcggaaacgacggggtaacggcgaggttgcagtatgcgctgaggcacgcgcgtcgggcccggcaatgccgtaccgcaaatccggatcttctaccctgaaaccgtccgggaaatcggacagaagccacctcacagtgccaccgaacgatggcactgggtaacccgcgtcaccctgtcaacgtcgttgacaccggcagtcaacgatgttgacactacggcggtaatcgtcgctgtccgaaagcgttcagtcatgcccactccatccggacggctcgcccgcccacccgcgtggaacgcgaccgtgccccgccagctcctctggttcatgctggtcggcgcgttgagcacggtcctgcagacgatcgtgtacgtctcggtccgcgacgtcctcgccgccacctgggccagctggctcgcgctgctggtggtcaccccggccaacaccgaggcgcaccgccgcatcaccttcaacgtcaagaccaccgcggtcgcccgcctccacggcgaggccggcctcacctcggtcgtggtgtacctggccaacctggccgtcgccccatggttcgccggcatcgccggcccgcacccggcaccgctcaccgaatccctgatcctcgccgtcaccggcagcctgatcggcggcgcccgctacgtcatcctccgcggctgggtcttcgccgcccgccgccacacccccgtaccctccaccaccgcagccccgaaactcacggacccgcgcgccgccggcctgaaggctgcgggtgcgggtgcttcaggtaccggggatctggacgatctcgacacggtggatcccggcgcccttgtcaccgcggatcggggcaccggagatttcgccgtcggtggcctcgccccggaggcacccccgtcgcagctcgtcggcgcggccacgtcagccgggaccgcgggcgcctccgacgacaggcgccgcaatgcgccgcgccacggtcgtccccctcgcatcatcccgggcgaaccggccgcaccccacagcaccgcccagcagtgcgtcccgggacaggccgccgacggatctttcgccggcaccctcccactggccgcactggcctgcctgggcaccatggctccgatcccggccgcccgcctgtgcctcggccagcccggcacaggggtcctcaatcaacgcccacccggccgtctccgaacctggcaccgcaaccgccgccggcacctcaccgcccgcagctgagaccagccgccgtctccaccgcgtccaccggaagcagcccgccaccagcgtgcccataccgggaacagcccgacggttgtcatcccgctcggcccacacctcgaacgggtggcgtccgacacggtccccggacgaggcaacttacgcatacgccacgttctgcccacccgggaccaccattcgccatcgacacccgtataaaggatctcccggcatcaggtactcgtcgacaggagccgtccggtggcactcgcactcccgatcgccgcgtcgttcgccgtcatctcggcgctcgccctgatcatggcccggctcgtcgacaccgaccggctggatcgcaacgcggccttcggcatccgcaccgccggcaccaaacgcagcgaccaggcctggaaagccggccaccgcgcggcccagcccctcacccgcgccctcggcatcaccggcctgtgcttcgcgatcctcatcctcggggtggccttcaccggcgctcgcaccgtcgtgacggtgactgccgtcctcggctacgccggcatggtcaccctgctcgccttgatggcccaccgggccgacaccgccgcccgttcctcatcctgaccaccccgagcgcagaagcacccccacggaaaaccctgaccccgcagacgcaaggcaccggcgtcaccgaacgcgccgcgcagtcagaccgtgggggcgggatcgtcgcaggtgagcagacgctggatggcgtcgccgtagagggtgatcacggcgtcgcggtcggcgtcggccaggaccgggtcgccgaccagccagaaggcgttgatcagcccggcgaactgggcggcggcgaggcgggcacggagctcggggtaggcgccgccgatgcgttcggccaacgggctgacgaagacgtcgtgcatggaggcgcggaggcgatccttgatctccgggcggtcggaggcactgagcaacgcgcggtagacgccggcgaccgggctgccggcgccgtccagaacgtagcggaccagctcgcggccgatcgtgtcgagcggggcggcgaggatcgcggtgaggtcgccggacaccgagacggtggccaggaacaggccctctttggacccgaaatgccggatcaccagcgccgggtcgcaccccgccgccgccgcgatggcccgcaccgtggtggcgccgtaaccgtcccggacgaacaggtccccggccgcacggcggatcgcgtcccggggcgggaggttctgcggtggcacacgatcatcttatggcggaatcctcaccatccatcgggccccgtcaccctcagcccgggacctccgaccccggacgaccccggcgccgtccgcctgaaccttcggatccctgatgagccgactcgtctgcccgggaccgccggccggatgggtcagcccgtacgcgtcgatcggtgaaggcaaccgccggcggtcgcgcccgaaagcaggaccggaggcggagcgggaagaagagccggcggccggccaccggagcgaatccccacgaatgtggggcggtggccgaccgccggagtcgatcgccggggtgggttcggtcgccggcctgccgacgacgccgacatccgtccggctcaacgagagaccgttccgggtggatgcggacccaaccatgccacgcgtcacgaggcaacacccgacggcattcctgcgccccgcccccgccacgggtcaaggcggcagcgagccgaggcagaagccggtcacgacggcgatcggccgaagcggggacaaggcggcagtggagcgaggcggaggggtcagtgcttggcggtgtagcggcgccgggtgaagaagagggcggtcaggccgccggcgatgagcgccaggccgccgaggcccaccgcggcgacgttggagccggtcagggcgagggcgccggatccggatccgggtgtgccgggttgcggggtggtggtcgcgaccacctgggtggcgggggtggtctgctgcgtgtcgcccggggtgtcgcccggctggccggtggcgggaacccggtcgcggggcaccggggcgccgatccggcacggtgcggtggcggcgacggtcaggtagccgagcgccacgtcgagcaggtgtgccgagccgagcttgacctcgacgcgcagcgatgcggcttcggcgcggaccacggtgtcgctgaggtgccgggtgaccttgccgacggagatccgtaccgacagcggtgacgcggggcggtccgcggcgaggcggccgagcaggttgaggctgacgctggtctggtcgccggtgaggccggggacgggtttgccggccgaggtgaccgcgagggtggccggttggtaggtgacggtggagtgtttccggtcgccgccggcgaccacttccagggtgggctggttgatcaccttggcggtgatctcctgcggggttcccgagaacaggatcacgtcgccgagggcgacgccggccccggagcgtacgccgatccggcccccgccgagcttgaccagggcggtggcgctccgcgtggatccggtcgggccgacggtgagcaggctggtccgccgggtgaggtgggtgagggcgtcgaccgcctggatggccgggactccgccggcgccgccgagcaggctgagtccctggaccatggtggtggcgcgggtgagcgggccggtgcggccgcagtggtacccgtcggtccaggtggcggcggcggtggccgtgccgagtcgggcggtggccaggccgccggcgttgagggtggccagggtgacgtcgaccgggccgcgtgggccgccgggggcgtgctgggcggcgaccgcgtcgtgcagcgggaggccgggcaggtgcatgccgagcagcttggcgtcggcatagctcgcggtggcgtcgctgcgcccggtgtggttgccggcgacgacctcaccagtggccggggcgagccggacgtcggcgagggcgggcaggtcgggggcgagcggccccggatcgagcacggtgatcttcgcgaggtcggcttcggacgtggccgcgaatttcccgatgccgcaggccgcctcggtagccgccgccggcgtgcccgccgcagacccagccgccccggacttggccgcccctgtcccggccgccccggacgcagccgttccagaaccagccaccccagacgcagccgttccagaaccagccaccccagacgcaaccgctccagaaccagccgccccagatgcagccgcatcggaaccagccattcggagagctgccgacccggggagagtcgatccgggcagggctgccgcggcgggggctgccggcagggtcagcgcggcgagggcgacgctagctagctaggacggcgggtgcggcaccccggggacgggacgcccggttggcgcggcggggcgcggtcagcgacggaacattcttcgccgcacgagcgatcggcatgaaacgtccttccggacataggaggaagtgtccgacgtttcatcggaccactcctaaatccggctacggtcacccgaccaaccccgcatcatccggtcataccggcaaatgctgctatcacctgctttagtccgaattgcgcttgtggtgccggcccggttcgagcccaccctccagctgctccccccgcagcagagacccctcctccggcgtcccgccgggcccctccaccgccagttccgggaatttcgcgtcgaacgccggccgctccgaccggatccgcggcatccggtcgaagttgcgcagcggcggcgggcacgacgtcgcccattccagcgagttcccgtgcccccacgggtcgtcgacggtgacgagttccccgacccggtacgacttccagacgttgtagaggaacggcagggtcgccgccccgaggatgaacgagccgatcgtcgagatggtgttcagcgtggtgaagccgtcgccgggcagatagtcggcgtaccgccgggccatcccctcggcacccagccagtgctgcaccaggaaggtggtgtggaagccgatgaaggtcagccagaagtggattttgccgagccggtcgtcgagcatccggccgaacatcttggggaaccagaagtagatgccggcgaagacggcgaacacgatcgtcccgaacagcacgtagtggaagtgggcgaccacgaagtacgtgtcgtgcacgtggaaatcgaccggcggcgaggcgagcagcaccccggtcagcccgccgagcaggaaggtgaccaggaagccgacggagaacagcatcggcgattcgaagctgagctggccgcgccacatggtgccgatccagacgaagaacttcatcccggtcggtacggcgatcaggtagctgagcaggctgaagaagggcagcagcacctggccggtggcgaacatgtggtgcgcccacacgctcatcgacagcccggagatcagcagggtggccgcgaccagcggcttgtagccgaacaccggcttgcggctgaacaccgggatgatctcggtgacgatgccgaagaacggcagggccaccacgtacacctcgggatggccgaagaaccagaacaggtgctgccagagcatcggcccgccggtggcgacggcgaacacctgggcgtcgaggatccggtcggcggcgagcgcgaacagggcggccgccaggaacgggaagaccagcaccaccagcaggctggtgagcaggatgttccacgtcatgatcggcatccggaacatggtcatgccgggggcgcgcaggcacaggatcgtggtgatcatgttgaccgcgccgaggatggtgccgacgccggagatcgccaggccgacgacccacatgttgccgccgacgcccggggagtgaccaccgccgctgagcggcacgtacgccgtccagccgaagtcggcggcgccgccgggcgagaggaagccgccgagcgcgatcaggccgccgaacaggtagagccagtaggcgaacgcgttcagccgcgggaaggcgacgtcgggggcgccgatctggatcgggacgacgaagttggcgaaggcgaacacgatcggcgtcgcgaagaacagcagcatgatcgtgccgtgcatggtgaacagctggttgtactgctccggggagagcagttgcaggccggggcgggccagctcggtgcgcatcagcagggccaggatgccgccgatgacgaaccagccgaaggcggtcgccatgtacatgatgccgatctgcttggcatcggtggtgcggatggtgcgggccagccatgacccacgcacctggcggcggaccggccaggaacgggtctgcaccggccgcggcgcgacggtcgtcattcaggcctcctgcgagaacgcactcgatccgttcgtactccccccaaatcgccttgccaacccgcgccacagccatcgttctcggtcaaccccgccgcggtgcgccattcgcacaaccacccccaagatcaacatagttgcccggtacgtcgttcatcccccgtccgcgcccggcccatccgccgggtcacccgctgtcggccccgaatcgtccgcccgatccggcggctcccccggccgcggctgcggatcggccacccactccggcggctcgccggggtgcagccgcgggtcgtccacggcgaacgtccgcaccggcccgcgcccggtcagcggcccctcgaaccgcacggtcacccgccccagcccgctgccctgcacccagccggcccccatcgcgtcgtgcaccacgtcctgccccggccgccacaccaccggcccggccgccggctccgccgcggggaccgccggctccggctcctcgggcgccgcgatggccggctcgtcgggcaccgtggccgccggcagcagcccgatcagcgcccctcgaccggccgcggcgtgctcctcggcgaacaggtcgtcctgggcgaagtcggccagcgtggagacgcccacgccgagcagccggatcccgccggacgtgtccagctcggcgagcagccggcgggccagctgcgccaccagtcggccgtcgtcggtcgggtggtcgcgggtgaacgcccgggtcagcgtggtgaagtcgccgtgccggaccttgatgttgacggtccgcccggccaggccgccggagcgcaggcggccggccacccgggcggcgagcaggtcgagctcgtggcgcagccggaccgggtcggtgacgtcgacgtcgaaggtctcctcggcggacaccgatttcgcctcgcgctcgctgaccaccggccggtcgtcctgcgcacgggccagccggaacaggccggcgccgtgcgactggccgaaccagtcggtcaggtgttccagggagaccgcggccaggtcgccgatggtgcgcacgccggaccggtgcaggcgctgctcggtggccgggccgacgccgcccagccggttgaccggcagcgggtgcaggaaggccagctcgtcaccgggagcgacgacggtgaggccgtccggcttgtgcaggtcggacccgatcttggcgagcagtttggaggaggcggcgccgatcgagccggtcacaccgccggtggcgaccgcgatccgcgccttcaggtccgtggcgagctcggtgaccgcccgcacgctcaggtcgccgccgacggccgcgagatcgacataggcttcgtcgatgctgacctgctcgaccagcggggacacctcggccagcaggcgcatcaccacctggctggtgcgcttgtaggcggcgaagcggggcgacaggtaggccgtgctccacggggcgagccggcgagcctgggccatcggcatggccgagcgcaccccgaagacccgcgcctcgtacgacgcggtggagaccacgccgcgcccggcgaccccgccgacgaccaccggcttgccgcgcagcgagggcttgtcccgctgctcgaccgcggcgaacatcgcatcgaggtcgacgtgcagaatgctcggatcccccctcacgatccgcagcctaaccaccgggtacgacatcattcccggtacgacattcccggtacgacgggagcgaaggagccgactgatggcgcaggacggactgacccgccagtcgaccctctaccgggccggcacggtgggccgccgccccgtggtgccggccgacttcgccgagctggagcgccgggcgcggcgcgtgagcagcgccgcggcctgggcctacgtggccggcggtgcgggcgagggccggaccatgcggcgcaaccgggcggccttcgaccgctgggcgatcgtgccccggatggcggccggcgcggtcgaccgggacctgtcggtcgacctgttcggcacccggctgcccagcccgctgctggtcgccccggtcggcgccggcgcgctgatgggcccggacagcgacgtggcgatcgcgaccggcgcggcggtcaccggaacgccgtacatcttctccaatcagggttgcaacccgatggaggagagcgcggcggcgatgggcgacaccccgcgctggttccagctctactggagcaaggaggaacggctggtcgacagcctgatcgcccgggccgaggcgatcggagcgggcgctctggtcgtcaccctggacaccaccgtgctgggctggcgcccgcgcgatctgaacctgggctcgctgccgttcgcccggggcctgggcatcgcgcagtacacgtccgacccggtcttccgggagatcgtcgcggagcgggcacggcaaccgcaggaccggccacgggtcacgctcggcgcgatccgggcgctgctgcggatgtcccgcaaccatcccggcccgttctgggcgaacctgcgctcgccgatcccccgggccagcgtggagaccttcctcgacatctactcgaaccccgggctgagctgggagcacctggccacgctgaaggggcgcacccggctgccgatcgtgctcaaggggatcctgaccgccgatgacgcgcggcgggcgctggcggtcggcgccgacgcgatcgtggtgtccaaccacggcggccggcaggtggacaacgcggtcgccgcgctggacgcgctggtcgagatccgcgcggcgctcgggccggagccgacgctgctgttcgacagcggcatccggaccggcgccgacgtgttcaccgcgctcgccctgggcgccgacgcggtgctgctgggccgcccgcacctgtacggtttcgccctggccggcgcgcacggtgtggccgaggtgatccgcaacgtgatcgccgagctcgacctcaccatggccctgaccggggtccggaccatcgcggagatcacccgcgaccgggtccgggctgaaccggccgggccgctcggcggtatcccctcgatgaaggaggtcgactgaccatggaactgttcttccggctgctgatgaacttcggggcgctcgggttcttcttcggggtggtggcactcttcgatcaccagtggctggtcggaggtctgctgatcgcgatcggcctgccgaccgcggtgatcccggtcgcgatagcgaccctgcggtcactgcgcagctggggaacgcagggcgcggcgtacggttcgctggacgacccggtgctgcgccggcggatcaaggcactgggcgccgtgctggtcgtgctgggcctggtcgcgttcctgtccggggcgaccatcgaggcgctgatctacgccgcgaaccacgcgcacccgccgatcccgctgccgctgatcctgctgttcgggctgatcccgtccggcctgctgatgttcctcggctattcaatggtcaacgccggccggctgaccctggccggggacgcggagggcaccgatgcgggcttccggctgggttggatcctgaccggtttctgcgtggtgttcggcggcgcggtcaccgatccgcggccgttctggcacatcgccggcctgatcgcgatccccaccggggtgaccgccgtgctctcctgtctcgcactgcgcgcgttgcgcaagccgatgaccgaggcccgccaccgctacttcgaggcgcgggaggcccagctccgggccgaaagagcccagccctagcaccaccgctggcagcagaccgtccccgcgttccggtccgtcgacgccacgaccgcgccatccgcgcgtacgtccaccggggcgctgccgggcaccagcttcccggctaccacgaacggcgccggcgcatcgatggacagcggcgattaatcggctgcagggcgggtcggggtggcggcagactgtccgccatgcactccgcgttcacggtgaccccggctcagctgcccgccctgctcctgcaggtcgcggtggtccggccggtgttcctgtggggcgcgccgggcatcggcaagagctcgctggtccgcgacttcgccgccgcgctgggcctggagtgcgtcaccctggtcggcacccagctcgccgccgaggacctgatcggcgtccccgagctgcgcgacggccgcagccggttcgccccgcccgaggcgatcgcccgcgacgagccgtactgcctgttcctggacgagttgaacgcgtcgtcgccggaggtgcagaaggcgttctactcgctgatcctcgaccggcggatcgggtcgtacgagttgccgcccggctccatcgtgatcggcgccggcaaccggaccagcgacaacgcgctcgcccggccgatggcctcggccctggtcaaccgcatgatccacgtgcacctgcgggcggcgtgggcggactggtcgcggtgggccgccgacgcggggatccacccgtgggtgctgggctacctcaccgaacggcccgatcacctgtgggcaacgccgccgaagaccgaggagacgttctcgacgccgcgcagctggcacatgctctccgacgcgctgcactcgtgcggggacacggtcgacgaggacacgctgcgactgctggccgggggcacgctgagcccgggccacgccggggcgttcagcggctacgtcaagatcgtccggcaccggtacgggctggacgcgatcctgcgcggcgacgccggctggccgagcgctccgggcgaccgtgacctgctgtattttctggccgaggcgttccgggcacgcctggtcaaagatctcccggccgccaaggaccgggctcccgcgtccgtccggcagttcgcccaccaggccaaggcgctgctggtcgaactcgccgagctgaatttggagtgcggccgcctggtcatcgcggccgacccggacggcgctccggtgctgcccgcgtggtttctggtcgaggtcagccgcgacctgccgcgcctggtcgcagcgcgcgccgcctgacgtgtaccacccacggatggtagggctcggcgattcgtcctggtcgcgccagcgacctgaatcgccgggcccgggagcggcgggagcaacgaccagttatcggccgcagcgcacgacatctgattgacgaatttggatctgatcatgggaaagaaatctgctcaggtcgatccccaggtcgcggcctttcaggcggcggccgggtcgctgcgcgcgcatccgatgttcgagcaactgttccgcgggtttcagcagccgagcgctacggtcacgctggtggaggattccggcatcgggttcgccctggtggatgccggtgggcggatccgggccaaccggacgaagcgcctcgacgtcgccgaatggacctgggtgatcgcgcactgtctgctgcatctgggattcgggcacctcgatccgtcagcggctcgtgatccggcctatcagcatgtcgcgtgcctcgcggtgacccgctttcagcgcgcggtgaagctgggtcgggagcccgggcagttcccggccgtgctgccgtccgccgacgagcatcgattgctggccgcttggcggcgttccggggtgccggccgccttcgccggttgcggcgcgggcacacccgacctcggcgcgcccgcgccggagagcaccgccggctggacggaccggttcgcgcgcggattgtccgcggcggcgaccgcggcggtcgacgtggccggcggcgcccgcgggtcgctcaccgggccggccgcgccgaaagccgcctgggatcgcgcgatgagctggttcaccgggtcgttcccgctgctcggcggggtggcggcggggttcaccgtggtggccgacgcggagctcgcgcggggctgggacatcgcggtggcggcggtctcgccggaggccggggagatctacgtgaatccgcgctgcgggctggacgggcagcagtggcgattcgtgctcgcccacgagatgctgcacgcggcgctgcggcacggcgaccgggtcggcccacgcgacccgtatctgtggaatgtcgcctgcgactacgtgatcaacggttggctggtggagatgggcgtcggcgtgatgcccgacggcctgctgtacgacccggcgctggccgggtcgtcggccgaggcggtctacgacctgatcgccggggacctgcggcggatgcggaaactcgcgacgctgcgcggcaggggacggggcgacgtgatcggcgagccgctgccgtgggccgggcggcgggccggcggggtcgacctggacgagtactaccggcgggcgctgctgaccgggcatgcctatcaccacagcggcgggcgcgggctgctgccggccgggctggaggcggagatccgggtgctggagcagccgccgctgccgtgggacgtgcggctggcacggtggttcgaggagcacgtgccggcggcggtccggcagcggtcgtacgcgcggccgtcccggcggcaggcgtccacgccggacattccgcggccgggctggcaccggccggagcaggtcgtgccgcgcggcaccttcggcgtggtggtggacacctccgggtcgatggacgagcggctgatgggcaaggcgctgggggcgatcgcgtcgtacgccaccgtccgggaggtgccggccgcgcgggtggtgttctgcgacgcggccgcctacgacgccggatatctgccggtcgacgacatcgccgggcgggtccgggtgcgcggtcggggcggcacgatgctgcagccggccgtcgacctgctggagcgggcggcggacttcccgcgggacgggccgctgctggtgatcaccgacggggagtgtgacgcgctgcggatccggcggccgcacgcgttcctgatgccgcgcggcgcgcggttgccgttcacaccgcgcggcgaggtgttcagcctgcggtgagtgcctccgggatgcggtagccggggtgcggctcggtgtccggctcccgggtcgggccgccggccgcggtggcccggatcaggaatgccgggccgtcggcgcaggtgatccgcacgccgagcggcaccttgccgcgggcgtcggccgggcccagatcgggcagcgcgagcagctcccaggagcggaacgcggccgggcgggcggcgtccagcagctgggcggcgaaggcggccgcccgggcggcgcgcagcgacggcgggggcaggatctccggcaccggcagcggcgtctcaccgggccagacggcgccccacaggtacgcctcggaacccgtgtcgtagcgcacccgcagaccggccggggacgggccgccgggcgccgggtcggtgccgaaccggtccaccgcggcgatctccggatgggcgctggtcagcagcagttgtcgcaggatgtcgagtacttgggcgagctgcacggcggtagctcacccgagatcgcggcggatgcggcgtccaccttgtgcgaccggctccgggcgtacccctacgggtggcccaggagggtcatgctgtgcctgtgcgtttccttctcaacgttctctggttcgtcttcggctccgggttcctgctcgccatcggctacgggatcgcggccctgatctgtttcgccctggtcgtcaccatcccgttcgggatcgccgcggcccggctggcggtctactcgctgtggccgttcggccgcaccgtggtggaccggccgggcgccggcgccgcctccgggctggccaacatcctctgggtggtcctgttcggctggtggatcgcgctgcaccacctggtcgtcgggatcatgcagtgcgtgacggtcatcggcatcccgttcgggatcgcgaacttcaagctggtgccggtggccttctggccgctcgggcgggaaatcgtggacgtcccctgacggatccggactgatcggacggagtggcaatggagatcaacggcctgttcaccggcatcgtcttcggcctgatcatcggcgcgctggggcgcctggtcgtgccgggcaaacagcacctgccgatctgggtgaccctgctggtcggcgtcgtcgccgggctgctcggcaccttcgtggcgaccgccttcggggtggacgacacgcccggcatcgactggatcgaactcgccctgcaggtcggtctcgcggcgctgggtgtggcgctggtctccggagccggccggcggcgccgcctctgacctcttcaccgacagccgaccgggcggcacggtaggttttcggtcatggctcgcgtacgcgccgcactctatctggacttcgacaacgtgttcagcggactgatcaagcaggacccggacgtggcgatccagttcgccaaggatccgggcgcgtggttggtccgcctgaccacgtcgctgaccgtcgacggcccgcgccgctggctgatcctgcgctgctacatgaacccgggcggctgggtgcccaacccggacaccgaggccaaccagccccggctgtactactcgcagttccggccgttcttcgtgaacgccggcttcgaggtgatcgactgcccgcggctgacccacaccaagaacgccgcggacatccggatggtggtcgacgcggtcgacgcgctcgccgacccggtgccgtacgaggagttcgtgatcgggtccggcgactcggacatgaccccgctgctggtccggttgcgccgggccgaccggcgcaccacgatcgtctcgccgtccgatgcggccgaggccttcaccgcggtcgccgaccgcctgatcaccagccaggaactgctcgaactggtgcagggcgagccggtcgacagcgacgaggcgccggtcgacccggagcagccggtctcctacgagcagttccgcgacctggtcacctggcggtacaccgcggccaccggcccgctcaacctggcctcgctcgcccacgacctgcgccgccagctcggccccagcgtcgatgagacgagctggttcggcaacggcggcttcgtccgcgccctggagagcctcagcctgccgaacgtcaagttctccaaccacttcctgtgggacgccgcccgtcacgacccaccggaggccggggtcagcaccggccccgctccggaaccggtcggccgcctgtcggcgctgctcagcctgccccggctgacccgggagatgtggccgccgatctaccagtcactcgccgagtacgccgcggcccaccacttcaacctgaccgaggcgacccgctgggcgcgcgaccagctggccgcccagggcgtcgacgtgagccgcagcgccatcgccttcgtcacccggggcaccgccttcggtggcgccccgctctaccgccagccgccgccgaacgccaccgagatcgccgcggcgttcgccgacaacgtgctgagccgtgccgaggccgccgcgatcgcgctgagcgacgaggagaccgccgaggtccgctcctggctcggcgccgcttagcggttcatgtcccgtcgtagtggccggtgatcctcggatcgccggccactttgttgtatccgcttgccatagtgtgtgagacacactatcgtttctgacatgacaatggatgcgacgctagcggggcatctgcaggagttgcggcgcggcaccgtcgtcgtcgccagcctcaccgtcctgcgcagccccggctacggctactccctgctggagacgctcagccgggccggcttcgaggtcgaggccaacacgctctacccgctgctgcgccggctcgaggcgcagggcctgctgaccagcgagtggaacaccgacgagccacggccgcggaagttctaccggaccaccgcgcagggcgatgccatcgccgagaccctgcgcggcgagtgggcacgactcgacaccgccatcggcgacctggacctgaacgggagcgcgaaatgaccaacctcgtcgaccgatacgtcttcaccgccctgcgtcgcatccccgagcagcagcgcgccgacatcgaccgggagctgcgcgcctccatcgaggacgcggtcgacgcccgggtcgacgccggcgaaacccgggaggccgccgtcgagaccacgctcaccgagctgggcgacccggagcggctcgccgaccggtatgccgggcgccccggccacctgatcgggccggatgtctatccgctgtggcgacggctggtcaccaccctgctctggaccgtgctgccgatcatggcgaccatctcggtggtcgtccagctcttcgaggacgccgacatcggcaagatcatcggcggggtggtcggcaccacgctcaccgtcggcacccacatcgtcttctgggtcacgctgatcttctggatcgtcgaccgcagtggcgccgccaaggggctccgcccccgatggagcgtcaaggacctgccgaaatacgaggcggcccgggccaccatcggccagctgatcaccggcgtggtgtggtcggcgctgctgatcctcgccctcgtgctgcagcagttcaccttcaccgacgtgccgctgctcgacccggcgaactggaccttctggtggccgctgattatcgccctattcgtgctgcgcgccctctaccatgtcggggtgcaccgggtcggcggctggacgcggacggtggcggcggtcaacctgctgctgaccgcggcgtacacggtgccgttggtgtggctggtcagcagcggccacttcttcaacccggccttccacggcttcctcgacgtccacggcggcgatgtccgcgactggaccggcacggcgatcatcgcggtcctggtggtcggcggcgcctgggacgtgatcgactcggtggtgcgcgccgagcggtcccggcgggggctggccccggccagggttcccgggtccggcgggggttacggcctcggctgctgacgcccgccgccgggccgcaagccgctcccctgtgcatcccacccgaactcggcgagtcacggctgcggctcgccgaggtcgcatgctcccgcctccggccgcagccccatcctgggccctcggcaagtcgcggcagtctcccgccacggatcgccgaagtcgcgcactctcgccatctccggccgcgcactcctgcacaccgccctcccccgctcgccgcgacgcgtccgccgcggtcaggtgcgggtgcgggtgagcagggcctggatccgggagaccagctcccgcggactgaacggcttggtcacgtagtcgtcggcgccggcgctgaacccgccctcgacatcctgctcctgtacccgggcggtcagcatgatgatcagcatgccggcggtggacggatcggcccgcaacatccggcacacatcgatcccggacagcagcggcatcgaaacgtcgagcaccgcaagggtgggatgatgcgcccgcgcctgctccacggcggcctgaccgtcgccgaccgtgatcacctcgagcccggcctgctccaacttgaaggccaccaggtcccggatgtcagcgtcgtcgtcagccacgaggaccgtggtcacggcagctcccctcgatcggcatcactaccaaccgaccataaccggttgtttacccatatgtcggtcggtcaccagctttgcctcagcctccactttcgcggccgccgccgtcctcgccgccatcccggcattcgcggcgggttcggcaccggtttcggccgcaaccgttccgcaacccgggtgcgcctgggctgcatcccggcagcggtgtcctggtttccaagcaaccaccgcgctacctcgaacggcccgggaggaccgatgaccgccctgatgaacgacgtccgcaccgaggcgctcttcgtctcggacctgcagcgctcgcagcagccgaccgcggagctgatccgcgaagcggtgtccgccaccgtcgaccgcctcggcgagaacggctgcgccgccctggtcgcccaggaattcggcgaacacccggactgcgcgatcggccgcatgcgctgggcccggtccgcggtacggctcgccttcgccgcctgacaccgcaagcccgcccaggcccaccggcaacccaccgcccactggacacaacccgcccacccagggggccgcccgcccaccacggattgtggcaggaaatcagcggatcgacggacgccctgtggacaacccggaggggcatgtcgccgccgaagctcctcagcggcatcgccaccgccgcgttcagcgggcgacacgaatgcagcgcccgttcaggcgacgccttcccggcgaagcggtgtcccatcacggcacgtacagcgcgaaatgccctgccgccgggagctggacagcggcgcgcaaccaccatgcgtacagcgcgaaatgccctcccagcggaagtcgacagcggcgcgcaaccaccgctcgtaccatcaaatgcccttccaccgggaggcgagcaacggcgcgcaaccaccgcacgtaccaccaaatgccctcccaccggaagtggacagcggcgcgcaaccaccgcacgtaccacgaaataccggttcgaccggaagtgaacagcggcccgtcatagggaaacgccgggaacaagggctggcgcagccgcgtccagcgccgctatcgtgtcggcatggatgcgcgcttgagcatgtggtggcccgcctgacggcggtcacacttcgcgcgcttcacaaccgcggccgcctcgtcgaggcggccgtttcgcatggtccggtctcggggagcggtcgcccggcccggaatgagggaccatgcctttcgcctacctgcaccgtgacggtgccgaccatgtcgaggtgctcaccggtgacgtgatcaccgtcgatgtgcttgccgacattccgctggacccggggcggccggtgctcgcggtggtgccgtaccggcagatcgccgagcgcggattcgattgtgtggatgacggggcgccgctggaatgcctgctggtggatgcggtgacgacccggccgttgagtgatttcccggccggtgagctgcgggtttccggaggtgcgttcgatcgggacgacgcggagtacgggcagatcgtcgaggaggtgctgcgggacgagatcgggcacggggagggcgccaatttcgtgattcaccgggtgttccaggcctcggtggagggggatccggtggcggcggcgcgggccgcgttcgggcggttgctcgcccatgagcaggggacgtactggacgttcctggtgcacaccgggcagcggacgttggtcggggcgacgccggaacggcatgtcagcgtgaccgacggcatcgtgatgatgaatccgatcagcggcacgttccggcacgggtcgggcgagttgctcgactttctgcgggatccgaaagaggtcgaggagttgtacatggtcctcgacgaggaattgaagatgatggccacggtggccgagcacggcggccaggtcgcgggtccctatctgaagcagatgtcgcagctgacgcataccgaatacctgctggccgggcgtggttcgctggatgttcgggacgtacttcgggagacgatgttcgcgccgacggtgaccggcagcccgatcgagaacgcgtgccgggtcattgcccgccatgaacgccgcgggcgacgttattactccggcgtcctggcgctgctgtccgtttctgatgatgggacgcagtcgctggacgcacctattctgattcgcaccgcggagatcaccgccgacggcaccctgcgggtgccggtcggcgcgacgctggtccggcattcgacgccggcgggcgagatcgccgagacccacacgaaggccgccggcattctggccgctctcggcgcggcgaccattgcggtacgtacgcagcccccacccgccccgggcgatgaggcgctgcgcctgctggcggcccgcaacgtggatctggcccggttctggctcgactcgcgggaggccggggcgctggtcgtcccggcgctggccggccggaccgcggtgatcgtcgacggtgaggacacgttcaccgcgatgctggcccaccagctcaaggcgctcgggctggccgtgtcggtggtgccgtggtcgtccccggttccggcggcggacctgctggtggtcgggcccggcccgggtgatccggcggacccggtcgatccgaagatggtcgcgatgcgcgcggtggtggccgaccggctggccgtcgggttgccgctgttcgcggtctgcctcgggcagcagatgctcgcgctgcggctcgggttgccgctgatccggcgggactcgccctatcaggggctggcccgggaggtggaactgttcggggtgcgccgccgggtcggtttctactccagtttcgcggcggtgtccccggccggttcgctggattccgtgcacgggccggtggagatcgcccgggatccggtggacgggacggtgcacgcggtgcgcgggcccttcttcgccggggtgcagttccacccggagtcggtgctgagccgggacggcatcgacgttcttcgtgaacttctgccgcctttgctggccgatgtggttagcccgctcccgaacgggtagcgatagggcgtcggtggtccaaggtgatcgagagcctcaccttggaccaccgccccgcgtcgagtccccctgccgcccccgctgcgggccgcgccgcaggtcggctgcccgggtccctgcggcgttgttcacaggggtagaaatcgcaggtcaccgcgcgaatgctggacgcatgccgatcgaagagcgcaccgcccaggccgtcgacgcgatcctcctccgccagcacggcgtgatcacctggcagcaggcccggcggcacctcagcgagaaggcgatccgccatcgcgtccggtccggccggtggagacgggtgcaccggggcatctatctcgcccacagcgagagctgcacccggcagcagtatctgtgggtcgccagcctcggcgccggcaacgggcggcccgcactcctcgccggcgtcaccgcgctgcaggtcctcgggctgcagcggctgcccgccgacccgctcccgatccacgtgctggtccacatcagtcggcccgaccgcgacccgccgcccggggtgcgggtccaccgcacccgtcggttgagcatggtggacgtctgtccgacgatcgccccgccgtgcaccaccgcggcccgcgcgctggtggacgcggtggagtgggccaccgacggcgacgacgcgacccgggtgctcgcggcggcggacggccagcgcctggtcagcccggagcaggtgcggccggtgctggcccggctcccgcgcctgtcccgccggcggctgctggagcgtgccttggcggcctgagcagacgccggccggcgcagcgccggtagcggcggaacacccggcgaagcaccggtggccgggggaaacatccggcaaagcagcggcggccggcggaacacccgggagagcaccggtggccgggggctgccgcgtgcgacgggcgccgaggcggtggcgatcctaggatcgaggaatggaggcgatctactatttcgatccggcttgtccgttcacctggaccacctcgcggtggctgacctcggtcgccgcggagcgtgggatccaggtgcactggcgggcgttcagcctgtcgatcctgaacggggacaacacgcccgagcagtaccggccgatgatggcggcgtccagccgcgcgttgcggctggtggaggccctgcgggcggatggccgcgaggaccggatcggggcgttctacaccgcattgggcgaccgtacgcatgaggcgggcaccccgatcaccgacgcgatcgtggcggaggcggcggaggcggccggcgtggagaaggcgggcgagatcctcgacgacccggcgtgggacgaggcggtgcgggagtcgcacgagaccgcgttgcggctggccggtccgggcatcggctcccccgtgctgcacctggccggggcggcgcgtgggctgcacggcccgatcatcggcgaggtccccgaccgggcggagtcgctggcgatctgggacgccaccgcggccctgatgcggatcggcacgttcttcgaggtgaagcgcggccgcggctgaccgcggaaccgacggggggtgcggaaaacggacggaaatccttcttcggggtgaaaaggcggtgcgggggcgggtcggcggggtttactgagcgttggtcgacgggtatccgcacggcgtcgttgacctccggagggacaccttggccgagccgcacgtcaccctcgacccgctttcgctgaacccggtggagcagaagctgcgtggtccgttggaggaccagctcagttcggcgctgcaggccgcgacggtcaaagtccggcagcgctattccggggagagcgtggagcaggtcaccacgatgcttctcgatcaggcgagggccgggctgcacccggacatcgccgccggtttccaccccgaccacgagcaactgcgccacgtggccgaggcgatcgtgagcaccgcgaactgaacacccctgaactgatacaccgcgactgaccggtccgccccggcgacaggacccgggccggtcagtcgtgcagggtcaggatcaggtcgacgaccagcgcactccagccggtctggtgccaggcgcccaggcccgcgccgttgtcgccgtggaagtattccgggaagacgatcaggtctttccagtccgggtgggtctggaagagttccgtcatgccgtagatcggccgccgccccgtcgagtccgggacgaacagggcgatcagccggcgagccaggtcgtccgccacctcgttcagcgacaccttcgtctgcgacccggtcggatactccacccgcaggtcttcgccgtagaactcggcgaactcccgcaacgcctccaccagcaggtagttgaccggcatccagaccggcccccgccagttcgagttgccgccgaacaggccgctggtgctttccgccggctcgtagccgacggtgaagtcggagccgcccagcgacaccgtgaacggtttctccaggtgggcccgggacagggtgcgcaacccgtacggcgagaggaattcctccgggtccagcaacctggccaggatccgcagcagttgctcctggccgaccatgctgagcagccgctggcggcggcggtcggcgccgccgagccggcgggcgctgatcacgtcgccgtagtcggtctggttgtgcagcatccagcggacccgggcgtttacctcgggcagccggttcagggtatccgaggtgagccgggtggtcgccgcgagcggcagcaggccgacgatcgaccgggccttgagcgggaccttgtgcccgtccggcagccgcagcacgtcgtagaagaaactgtcctcctcgtcccacaggccctgccggtacgccgcctcggcgatgtacgtgaagtgctcgaagaacttggtggccatgtcctcgtaggcccggtcgtgcagcgccagattgatcgccatgtccagcaggttgagggcgtacatcgccatccagccggtgccgtcggactgttcgaggacaccggcgaccggcagcgcggcggagcggtcgaacgggccgacgttgtccaggccgaggaagccgccctcgaacacattgttgccgccgacgtccttgcggttgacccaccaggtgaagttgagcagcagcttgtgcatcacccgggacaggaagtcgtagtcgcggccgccgtcgatctcgaagacgcgcagcgccgcccacgcgtgcaccggcgggttcacgtcggcgaacgaccattcgtacgccggaatctggccgttggggtgcatgtaccactcgcggagcagcagcagcagctgcgatttggcgaagccggggtcgacacggctgatgctgacacagtggaaggccaggtcccaggcggcgtaccaggggtactcccacggatcgggcatgctgatcacgtcgaagctgttcatgtgccaccagccgttgttgcggccgtggcgccggcccggtggcggcggcgcgttgcccgggtcgccgaccagccactgcttcacgtcgaagtggtagaactgcttgccccacatcagaccggcgatgccctgccgggcgaccgcggcctcctcctcggtggccgccgccgggatgatcccggcgaagaacgcgtcggcttcggcctgccggtcgcgcatcaccgcggtccagcctcggcccaggtcgagcggggcgggcggggcgtcgctctgggtgagccgcagccggatcgtccgggtcgcgccgggcttgagggtgaccaggtagtgcagggaacctttggtaccggtcccggccgggttgaccgtcggcgcgtcgtcgaccaggaagtcgttgatcccgtccttggggtacgggctgcgcccgggcagtccccacagccgctgcgcgttggtctcgttgtcgcagaccagggccggcggcttgccctcggcgtcgagggtgatctggccgatcgagcggtgccggccggtgagccgcccgggagtgccggtcagctccgggaccggacggttcggcaggccccacgcccaggtgttgcggaaccagagggtgggcaggacgtgcaggctcgccttctccgggccgcggttggagacggtgatcgcgatgcacatgtcgtgcgggccggctttcgcgtagtcgacggtcaccgcccagaaccggtcggagtcgaagatgccggtgtcgaccagttcgtattcgctttcggtgcgggaccgctggccattcacgcgaaccaattgatcgtacgggaattcagcctgcggatagtggtatcgccagcgcatccaggagtgggtgggagtggaatcctgataccaccagtaatccttggcgtcctcgccgtggttgccgccgtcgccgccgaggccgaacatccgctccttgaggatcggatccttgccgttccacagcgcgagggcgaagcagaacgtctgccggtcgtcgcagacgccggccatgccgtcctcgttccaccggtaggcccgggaccgggcgtgatcgtgcgggaagtagtcccacgccgtcccgtgctcgctgtagtcctcacgaaccgttccccaggcccgctcggagaggtagggaccccaggctcgccacggctgctcgccggagtcggcctgggccagccgatcccgctccgacacgtccgttctcaccatccccaccaattacgaccaggagtcgatcacactgagactgtcacggtctggtgtcaagtgtgtcggctccgccgattctgcccataggtcggaggtccccatccgtgtccaccgtgcgcccgatcaccttcggaccgcaggtctgtaccgatctgaccagtggatcgtctcgtgaatggctggtacccgacggggtggggggctatgccatgggcaccgtcacagggctgcggacacggcgatatcacgggttgctgatggtggccggggacaccccggcgtcccgcatgttgggcctggcttctctcgatccggtcgtgacgctgccgtccggagcgcgggtgcggctcgcctgccacgagtgggcgggcggcgcgatcgagccgcaggggcacaccctgttgtccggtttcgccctgatcgacgggatcccacgctggcggtggcggatcggcgacgtggtgatcgagcgggagctggcgatggtcaccggccggccggcggtcgccgtcgtgcaccggctgatctccggcgggccggtgcagctggccgtcgaggcgctgtgcacctggcgggaccagcactcgtcgggcttctccggcatgtcgctcccggtcgcggacggctgcgtcttcgccggcgcctaccggatcgccgggccgggcttcgccgcggccggcgaacgcttccgcaaggtccactaccgggccgaggcgtcgcggggcctgccggccgaggaggacctgtggtacgcgggcagcttccacgccgcgctcgacgcccccgggaacatctgcgagatcgccgcctgggccggtgagctggacgatccgccgccgccggcggcccgggtggtggacggggcacgggcccgcaaccggcggatcggcacggatccgctcaccctggccgcggacgcgttcgtgatccgcacgcgcaccggaccggacgtgatcgccggctacccgtggttcggggcgtggtcccgggacacgatgatcagctacgaggggctcttcctcgcgaccgggcgggttgccgaggggcgcgagctgctcacggcgtacgccgcacatctgtctgaagggatggtggcgaacaccgcggacaccggccgcgtcgagtacaacaccgtcgacggcacgctgtggttcatgcacgcggtcgaccggcacgtcaccgtcaccggcgacaccgatctcgccgcggaacttggtccttccctcaaaagcatcattcaccaccatattgccggtacgcggtacggcatccgtgccgacccgcacgacggcctgctccggcagggcgccccgggcgaggccctgacctggatggacgcgcgcgtcgacggcgtgccgatcaccccgcgctcgggcaaggcggtcgaggtgaacgcgctgtggatcaacgcgctggccaccctcgacgacagtttcgcgccgctgctgcaccaggcgcgggacagcttcgcgcggtccttcccgaccctgtccgggctgctccaggacgtgctcggcgagcacacgctgcgcccgaaccagctgctcgcctggtcgctgccgcacgcgccgctgcgccccgacccggcggtgctgacccggatcggggcggccctgctcaccccgatggggctgcgctcgcaggcgcccggcactcccggctaccacgggcggcaccggggcgggccggccgagcgggacaccgcgtaccacaccggaacggtctggccctggctcaccgggccgtacgtgtcggcctggcgccggctcggccgtgacgtccccgacgtgctggccgacatcgaccaccacctggccgaatacgggctcgggtcgatctcggagaccgctgacggggacgccccgcacaccggcaccggctgcccgttccaggcctggtcggtcgccgagcacctgcgggtccgtaaattctgaccattgccggaaaccgtccgctgcccggaatcgcacccgaatcgcaaccgggggtcgcgacgatgagcggatggatcgcacccggctgtggcggctctggctcgccttcgccgctctctgcgcgctgttccgctgcgcggggcagctcgccggcctgccgttccacgtgtacgagatcccctacatgatcgtcacctgcggcgccccgctggcgatcttcgccggtatcgcgatcaaccggccggcccgccggtccggctgggtcgtgctggccctgggacaggtctcgtacgcggtggcggacgtcatcttcagctacaacgtgttgaacaacagcgaacaggccgagcccgcgctcagcgacgtcttctacctgaccagttacgtgctgatcggcgcggcggtgctggtcttcatccggcgccgcacgcccggctggcacctggccagcgcggtcgacgcgctcgtcctcgcgctgtcgagcggcctgctcagctgggtcttcctggtcgggccggtggctttcgacccgaccatctcgttgccggcgaagctgaccgaggcggcatacccggtgctggacctggtgatgctgctgctcgccgtacggctggtgctcggctcgggcgcccgcagcgtcgccctgggcctgctcttcgcctacctcggcaccatgttcgtggccgacaccggatacgccgtcctgggcatcctcaccgcgcagaacgccagcgagccgttcaccggtggcctctacgccacctcgatcggcctgttggcggcatgcacgctgcatccgtcgatgcgggacttcgaaacgcgcagccaggtcgcgccgccggacgccacccctgcccgcctgaccatgctgacctgcgccgtgctgatggtccccggcctgcagttcgtcgagcaccaatacggccgcgacctgagcatccccctcaccagctccacctgcgccgtgatgtttctgctggtcatggtgcggatggcgggcctggtcgcggcccagcgccgggccgccgacaccgacggcctgaccggcgtgtgcaaccgccgccacttcgaacaggtcctggccgccgaatgccgccgcgccgcccgggtcggctaccggatcgccctcctcatgatcgacattgaccacttcaagaagatcaacgacacctacggccaccccggcggcgaccgcgtcctgcgcgaactcgcccagcgcctggccaccggcgcccgggccggctcactgatcgcccgctacggcggcgaagaattcatcgccctcgtcccgcacatcaccggcgacgacctgccactgatcgccgaacgtgcccgcctggccgtcagcggcctgcccatcccggtcaccggccagaccctgatcaccgtcaccgcgtcgatcggggcggccgcggccaccggaccgctcgccgacccggcggaactgctgcgggcggcggacgaggccctctacgcggcgaagtcggcgggccgcaaccggtcggtgatcgcacccgaggtccgcgccccggccccggccgcctgaccaggccgcgcccgacctttgcgccgagaatccgcccggccacggccacgccgccgcactgccgactcgctgcgccctgcgtgaccgcggacctggcccggccgcctttgagcgccgccgccccgagccacgaagtcggcctccgtttgacggcaccgcggcacgcagactcgccgcggccgctggtcggccgggtggcgttggttggccggatggcgttggttggccggatggcgttggttggccaggcggcaggcggcgctggccggccaggcggcgcgcccgtcgcggcgacgttcacgccgcggcaaccgcccgccgatagggtccgggaatgcctgcctccgattacgtccggaaccttcgcgaccgcgtcggccaagagctgatcatgttccccacagtgtccgcgatcgtcctcaacgaccgcggcgaggtgctgttgcaccagcgcagcgacaacgcccgctggcacctgatcgccggcctgatggaccccggcgagcaaccggccgacgcggtggtccgcgaggtcgaggaggaaaccgcggtccagatcaagatcgaacgtctggccggcgtggtctcacacgacgtcacctacctcaacggtgatcaatgccaaatggtcaacgtcttcttccgctgccgcgcgaccggtggtgaggcccaggtcaacgacagcgagtcgctggcggtcggttggtttccgctggacgccctccccgagctcgacagtttcacccagcgcatgctcgcgttggctcttgacgagaacgcgcctccctatttcgccgctcccggtgaaggcggtttctgaggtcgcacctccctgtttcatcatccggcaggaccgcatctgattcgttctccgttcggcccccatcgtggcagaaaaaggccgtcggaggttcggcctgtggataactcgaactgttcggttgtccacagtgcagcggcgggcccagcacattcctgcgatgattgctggaggcgggcggccccctgggtgggcgggttgtgtctggggcggttcgagggcggcaggcatctggactcccggcatgcggtctgcccacggcacccggtcggctgggcaaggcagtcagcttgagcaaggcagtcggcttggacaaggccgtcggcttcagcaaggcagtcggcttggacaaggccgtcggcttcagcaaggcagtcggcttggacaaggccgtcggcttcagcaaggcagtcgccttaggcaacgcggtcaccttggcgcacgcgatccctgggcaggcgatcgccttggggcacgcgatcggctgggtcaggcgagccagccgggccggatcaatcccgcctcgtaggcgtagacgacaagctgagcccgatcccgcgcccccagcttgatcatcgttcggctgacgtgggttttggcggtggccgggctgatcaccaggcgggcagcgatctcgtcgttggagaggccttcggcgaccagggccatcacttcgcgttcccggtcggtcagctggtcgagttcgcggggcggttcgggccggcggccggtgccggagccggcgaattcgccgatcacccggcgggtcacgctcggggagagcagggcgtcgccggcggcgacggcgcggactccgcggagcagttcgaccggttcggtgtccttgacgaggaagccggaggcgccggtgcggagcgcttcgaagacgtattcgtcgagttcgaaggtggtcaggatgaccacccgggtgtcggcgcagaccgggtcggcgacgatcctccgggtggcttcgaggccgtcgacgccgggcatgcggatgtccatcagcaccacgtcgggtcgggtggctcggacgagggtgacggcctggacgccgtcggcggcttcgccgacgacccggatgtcgggttcggcgtcgagtagtgcgcggaatccggcccggaccagcgcctggtcgtcggccaacaccaccgagatcatcgattcccctttgtggtcacacggttgtcggtggtgtccggggccgccggttcgtcgggttccggccggccggtgggcaggatgaccgtcacgaggaagccgccggtcggcggccgtcccgcttcgaggcgcccgccgagcgcctccgcccgggcgcgcatgcccacgatgccgctgccgctctcgccgtcaccacccggcggcgacgagggagcccgcacacccacgacgccgttcccatcgtcgccggccggcgccggccccgagacccgcacgcccaccatgccatcgccggccagcggcaacgccgggggcccgggaggcgccggggacggcgccggaccgccgttacggatcgacagatacagcgcggccggcagataactgaccgcgacatccgcttcgggttgcggtccggcatggcggcggacgttggtcagggcttcctggactatgcggtacgcggcccggtcgacctccgcgggcagatcccgcggttcgccggtgatggtggtgcggaccgggatgccggccgtggcggtgagttcgccgagccggttgaggccgagggcgggttggcggggcgcggcttcgccttcggtgcggagcacgccgaggacggagcggacttcgcggagggcttcggcgctggcgctcttgatcgcggtgagtgcttcgcgggcctgttcgggtcgctggtccatcaggtgcaggcccacgccggcctggacgttgatcagggacaggtggtggccgaggacgtcgtgcagctcccgggcgatccgcaggcgttcttcggaggcttggcggcgttcctgctcctcgcgggcgcgcgcctgttcggcccgggtgcgggcctgttcggcgtagttctcggcacggatgcgggcggcgccgccgagcaggacggccaggccgagcaggacggcgaccaggcaggtctgaccggcgaccgggcggacgccggggttgaggccgagccggccggagaggccgacggtgacgccgacccagccggcccaggcggtgacgccgcagatcagcgcggcttggcggcggccctggcgggccacccagtagagggcgacggcggcagccgcggcataggccaggtgcggcatggcgtgggtggcgaagatgatcgtggcggtggcggcgaccgtgaagaccaggatgggggcctgccggcgccagaacagggcgagtgggccggccatcagcgtgagggtggtcaggacgtcccaggggcggtagaggccgccgtgcgcgatcaggttgctgacgccgcccaggtggacgaccgcggtgatcacggtggcgccgggtggccagccgcggtgcgcgtcgcggatgcggcggcgccagggcggcccaccgggctcgaccggcggcccgcaggcccgggttgcccgcttccgccgcttcctcatgcagccgaaactacgtcactgcgacgcgtcccggcatcggcctcggatctgtttcgggggtacgcccgcgggcgtacgccgaggcactccggtacgccccacgacgtaccgccggccggcatcgatcccgggaccactccccgcgattgcgccgcccggacgacgtcgccgggcagcccggcggggactctgggaggcaggcaccacccgaggaggacatcgtgcatcccgaacaagtcaccccgccccggctgcggacctccgactccgagcgtgagcagatcgccgggctgctgcgggaggcgatgacggaggggcggctcaccctggacgagggtgagcagcggctgggcgccgcgtatgccgcgacgttccgcgacgatctggacgtgctggtccgggacctgccccgcggggatcgggggacgggcgcgacacgccggtccatgcagcgccatctccgtctcgtggtgatcgccgccgggctgctggtggctctgtggacgctgtccggcgccaccttcttctggccggtcttcccgctgttcttcctgctgacgggtttgttccggcacgcccggtggcaccgtcacggcgtaccggcgcggccccgtttctgagcgccggctgtcgggtggccgactccactccggtgtggaccccccggtcgttgatcttcatgcccggctctgcgagagtgtcgcagcttgttcggggagggacgacgcacatgatgggtccgtcgcacgcactgtcgggggcggccgcctggctggccggcagctgggcgctcgaccagttcgccgattatcaccagtcaccgctgatgatcggcgtgggcaccgcgatggccgccgggggtgcgctgatgcccgacttcgacctgtccggcaaggtgaccaccaatcagggcggggccacggtggcccgcaccttcggggtgttctcgctgttcgtggccgaggtgatcgagaagatctcgctgggcatctacaccgcgacccggcagtcccgggacccgaagcgggatcacgggcaccggaccttcacgcacacgctgccgttcgccgcgctggtcggctggggcaccaccgcgctggccgcgcactacggcaagtgggcggtggtcggcatcatcttcttcatggccggtctggcgctgcgcggcctgttcgagaagtgggcggagaaggccggctggctgatcgtcaccctggccgccgccgcgatcgcctggttcaccgcggcgaacctgcccggcgaccggggttatccgctgctcggtttcgcggtcggcgccggctgcgtggtgcacctgctcggcgacatgatcacgaagaacggtgtgccgatcttctggccgatcccgaccggccggggccggatgtggcggatggtcggcatcccgaaccgcttcgcggtgaaggtcggcggcaagaccgagacggtgatcctgagcaccgccttcaccatcgtctcggtggtctcgctgatcggcctgttcgccccggtcctgctggaccgtctccacctgaacctctgggcgtcccggtagaggcgcgaccgtcaggtgccccgcaacgccgtgatcaggcccagtgcctggtgcagcgcggggcgcatgacgggtagccgcgacagcttgacgaccttgtcgatcagcggtacggctccgtcgatgagcatgcgggtccgtcgttggtccggcgagccgtcgtgcacccagaagaggatcacccccatccagcccagccacagcagctcggggagctgggcgcgaagctgcgggtcgaggcgcagcccggacgagctcacgacctcgcgaaagaggccgatcgcggcttcccgggacggcgccgacgccggggagaaggggctgagcggtgacgacggatccgctgccgtcttgaagaacgtcccggcgaaggcgtggtacggcgcgttgacgtcgatcccggcgtgcagcaccccccgcagccggcccgcgaaggtccgctccgaggcgaagacccgggcggccgcggagcggtgggcgagctggttctgatcgtagaagccctggatcaggtgttccttggagtcgaagtagtagtacgcgttgccgaccgccaccccggcctcccgggcgatggcccgcatggtcgtctcggcgtagccccgctcctggaacagacgcagcgcggtaccgaggatgagttcgcgggtctgctcgccccggacccggcggggacgacccgccggcccggcgggcggcgtctcccctgccgaggccgggtcggccggcgatgtggagccgtcgggcggcggatcgggcggggaggcggcgtcggcggcggtcgtcacatccgtcacggtagtggccgcccgggtgccggacgccgccggtgtacggcccccggcgggagtcatgccggcgttccctcggccgccggcgccgcactcccgaccgtgctctgctgcggtgccggagatcgcgcgggcgccgcggcgtacgggggcggggggtacgcggccgggtggccggcggcgtacgggtaggcgaccgggcccaccggggggacgaccaggcccggcatgacgccgggcgggtacgccgggaacggggtgcggccgggtgtgggcgccgccggacgcagtcggccacgccggtagcgaccgaggaagaagacgttgctcaggtgcagcgcgcccagcaccagcaacacccagccgatcttcccggagagcttctccaacgcctcggcggcgttgccgatgcgatcgccggtgcgcatggcgatggccaggtagcccaggttgagcaggtagaaccccatgaccaggagctggttgacggcccgggccagccggtcgtcggcgaagacgtcggtgaggaagaccattccgttgcgggcgagggtggtgcccacccagatcgtcagggcgacgctgacgacgaggtagccgaggtacatccacatcttcgggtccatgtcggcccctttcttgaacgtgttcaacaacgctgagcataggactgttgttgaacgtgttcaagtactgtgagcggggtcgccggcgtcggcgccacgcggccgacaggtcacggaatgcggactatcgcggatcgactcccgggcgggcgaggcccggcacccgggttccgccagtggacgccggacggcacgaacctaggccagccgccccagcacccggttgatgatcttgtcgagtggcagggtcgcgtcgacgcccagcccgttctcgtccggcgccagcggctccagcgtggcgaactgggaggcgaccagcgtgctcggcatgaagtgcccggcccgggcgctcacccgggcggtcgccacctccggcgtcagcaccaggtgcacgaagaacgtccgcgggtccggtccgcgcagcacgtcgcggtaggcgcgtttgagtgccgagcaggacaccaccagcccctgctcccccgccgtcgcgatccgggcggcgatcgcggcgagccacggcgcccggtcggcgtcggtcagcgccagcccggagtgcatcttggccacgttggccgccgggtggaagtcgtcggcctcgccgtacggcacgcccaggcgtgccgccagggcggcgccgaccgtgctcttgccgcagccggcgacccccatcaccacgatcggcaccattcccgcgaacccctgtcagtcgatcggatacgccaggttggggcgcagccagcgttccacctcgcccaccggcacgccgcgccgggcagcgtagtcttcgatctgatctttacccaaccggccgacggtgaagtacttcgcgtcggggtgggcgaagatcaggccgctgaccgcggcggccggggtcatcgcgtacgactcggtcagggcgaccccgatccggccggtgtcgagcagctggaacaggtccttcttctcgctgtggtcggggcacgcggggtagcccagggccgggcggatgccgcggaaccgctcggcgtgcagatcctccagtttgggctgggcgtccggctcgaaccactcacgacgggccttgaggtgcaggtattcggcgaaggcctcggccaggcggtcggccagcgccttcaccatgatcgcccggtagtcgtcgtgctcggcctcgtatcgcgcggccagtttctccgcgccgtggatggccacggcgaagccgcccaggtggtcgccggccggcgcgatgtagtcggccaggcagcggttggcgcggccggccggtttctcggtctgctggcgcagcatcgggaaaccgtgcccgttgtccaggaggatgtcgtcgccctcggcgtgcgcgggccagaagccgtagagcccccgggcctggaacgaaccgtccgcgatgatctggtcgagcatcgcggtggcgtcgtcgaacagctccctggccaccggctcgttgaggatcgccgggtacttccccttgagctcccaggccaggaagaggaactgccagtcgatcatctcgcgcagctcggcgatggtcggctgcacctcgcggaccccggtgaaggtcggggtgggcagcccggtgaagtcgacccgttcccggttggcccgggcctgggcgagggtgagcagcggctgggcgtgccgcttctcgtgctgctcgcgcagccgctcctgctcggcccggttcgcctcgtcgagcttggccgaccgctccgggtcgagcaggtcggagaccacgccgacgacccgggaagcgtccagcacgtgcacggtggcgccgtcgtaggccggggcgatccggaccgcggtgtgctgcttggaggtggtggcgccgccgatcagcagcggcagggtcatcccccggcgctgcatctcggcgccgaccgcgaccatctcgtcgagcgacggggtgatcaggccggacaggccgatcgcgtcggcgccctcggcgatcgcggtctccaggatcttcgccgccgggaccatcacgccgaggtcgatcacctcgtagttgttgcagccgagcaccacgccgacgatgttcttgccgatgtcgtggacgtcgcccttgaccgtggcgagcaccacccggccctggccgcgggagctctcggtcttgtccttctccatgtagggcagcaggtaggcgaccgagcgtttcatcacccgggcgctcttgaccacctggggcaggaacatcttgccggcgccgaacaggtcgccgaccacgcccatgccgtccatcagcgggccctcgatcacgtcgagcggccggggcagcttgagccgggcctcctcggtgtccgcctcgatgaagtcgacgatgccgtgcaccagggcgtgcgagagccgctgctcgaccggggcgtcccgccaggacaggtcgacctcgcgtttggcgccgctgccggtgaccgtggaggcgaaggtgaccaggcggtcggtggcgtccggccggcggtcgaagagcacgtcctcgaccagctccagcaggtcggccgggatgtcctggtagacggcgagctgaccggcgttgacgatgcccatgtccaggccggcgcggaccgcgtggaacaggaacgccgagtgcatcgcctcgcgcaccacgtcgttgccgcggaaggcgaacgacaggttggagatgccgccgctggtgcgggcacccgggcagcgctgtttgatcagcgggagggcgtcgatgaacgccttggcgtacccgttgtgctcggcgatgccggtggcgaccgccagcacgttcgggtcgaagatgatgtcggtcgggtcgaagccgtcctcgaccagcaggtcgtaggcacggccgcagatctccaccttgcgctcggtggtgtcggcctggccctgctcgtcgaaggccatcaccacgacgccggcgccgaagtcacggatccgccgggcctgccgcaggaagaggtcggggccctctttcaggctgatcgagttgaccacggccttgccctgcacgcacttgaggccggcctccagcacgttccacttcgagctgtcgatcatgatcggaatccgggccacctcgggctcggtcgcgatcaggttgaggaacgtggtcatcgcccgctcgctgtccagcaggtcggcgtccatgttcacgtcgagcaggttggcgccgccgcggacctggtccagcgcgacgtcgacggcggcctggtagtcgtcggcctcgacgagccggcggaaccgggccgagccggtcacgttggtccgctcgccgatcatcacgaaaccggtgtccgggccgatcgcgaacggctccaggccgctgaaccgggtggtcggcgcgggcggggcgaccacccggggcgcggcgccggcgaccgcccgggcgacctcggcgatgtgcggcggggtcgtgccgcagcagccgccgacgatgttgaccaggccggacgcggcgaactcaccgatcagcgcaccggtctccgcgggggtctggtcgtagccaccgaacgcgttcggcaggccggcgttcgggtgggcggcgacgaacgtgtccgacagccgggccagctcggccacgtgcgggcgggcctcggccgcgccgagcgcgcagttcagcccgacgaccagcggtcgggcccgctcgatcgagcgccagaaggcctccacggtctgcccggacagggtgcggccggacaggtcgacgatcgtcaccgacacccagagcggcaggtccggggcgacctcgcgggccgccgcgatcgccgccttggcgttcagcgtgtcgaagacggtctcgatcatcagcaggtcgacgccgccctcggcgagcgccgcgatctgctccgcgtacgcggtcttcacctggtcgaaggtgaccgcgcggtaggccgggtcgtcgaccttgggcgacagcgacagcgtcacgttcagcgggccgacgtcgccggcgacgaagcggggccgtccgtcggcggcctcggcctcgtcggcggcctgccgggccagccgggcggcccgcacgttcatgtcgcgcaccaggtgctccagcccgtagtcggcctgggcgatggtggtggcggtgaaggtgttcgtggtgatgatgtcggcgccggccgccagatactgccggtggatgtcgaggatgacgtccgggctggtgaggttcagcaggtcggggtcgccggtgacgtcctgctcgtgatcggccgggatcaggtcggcccggtagtcggccgggctgagccgggcgccctgcagcatggtgccggcggcaccgtccagcaccaggacccgctcggcgaggagctcgcgcagcgtggcgacagactgggtcacgggtacacctccgagagaagtcggaggcgcccttgctcgcggatcaccggtcgagcgtgacgggtgatcccgctgcagcgcctctcggccggacccataacgatacccacttcctcacttggcttccgcgtagcaaccaaccactgagacgtccagcgggaagcgcacctcgctggcgccgaacagcatccgcccggcccgcgcggcgcactcgcggatcgtctcggcgacctgttccgcctggtcagccgggcagtgcacgaccacctcatcgtgcacgaacaggaccagctcggccggcgtcccggccagcgcggtgcgcagggtggccagcagcaccagggcccactcggcggcggtggcctggatcacgaagttccgggtgaatcggcccctcgcccgtccgggtggcggggccacctcatcgggcgggtcgagcccggcgtcgcggcccgggccggccgccggcgggcaggtgcggcccagccaggagcggaccagcccgccgttctccccgacccgggcggcctgctccacgtactcgaacgcggtgggatagtgccggcgcagcacggccagggccgggatggcgtcgccgccggtctgcccgtacatcgcgccgatcagggcgatcttggccttggcccgatcgccgtcgaaggagtcgcgggccagctcggcgtagaggtcgccgccggccgcggcgcgggccagcccccggtcgccggagaccgcggccatcacccgcggctccagctggccggcgtcggcgaccacgaaccgccagcccggatcggccagcaccgcgcggcgcaccaccttggggatctgcagggcgctgccgccgcgggcgccccagcggccggagacgacgccgccggcgacgtattccggatggaagcggccgtcgtggacccaggagtcgagccaggaccagccgtgcgcggtccagatccggtagagctccttgaactccagcagcggggcgaccgccgggtggtcgacccggcggagcacccagcggcgggtgttcgggatctggatgccggcccgggcgaacgcgcggaccacctcggccggcgagtcggggtgcagcccgtgggtgccgaacgcctcgttgatcgccgcggtgagctcggccagccggcgcggcgggccgaccggctgcggcggccccagcagctcgcgtaggagccggtcgtgcacgtcggcgcgccacggcaggccggtgtggcccatctcggcggcgatcagggaaccggccgactcggcggcggccagcatccggaaccgtccggggtggccggtctgcgcgaggcggcgctgctgatccgcgtacaccgcaatcaggtcctcggcggagaccgcgacggccgtggggaacgtcgcgaagagcgcgccctgggcgaaaccgggcggctcggcctcgggccggggccggtcggccgggaccgggaggccgcgcagccgggcggtcgcggcggcgagcccccgtggctcgccccagcgaccggcgtgcccgagcagcagcgcttcggtcagctccaggtcgtggcaacgggccacccggacgccggcgcgcagcagcgcgggataggtgtcggcggtggccgcccagatccagcgcggctgctcggcggcctcgcgcgcggcgatcgccgccggcaggtcgggcgccgggtggggcgccccgaccggccgcccgtcggcacgcagatcctgcagccgaccgtcagggagtaccgctacgagcacatggtcattctgctcgcggggtacgacaacctacttgacggcaccggcggtcagacccgcctggatctgccgctggaagatgccgtagacgacgatcatcggcaggatcgacagggtcagcgcggcgaacagcgtggaccactcggcgtggtaaccggctgaggtgctgatgttcgcgacgccctgggtgagcacccacttcgagtcggcgccggcaccctgcatgatcaccaccggcagcaggtactggttccactgcccgacgatgttgaagatcgtgatgctgaccaggccggacttggccatcggcatcatcacctggaagaaccggcgcagatgcccggcgccgtccatcatcgcggcctcgtcgatctcggccggcagcgtctggaagaacgcggtcaggaagaacaccgtgaacgacagcgagtacgcgatgtagaccaggatcaggccggtgtacgtgttgagcaggctcaggctctgcaggatgccgaacagcgggccgatcgccatgaacgtggggaaggccaggccggagacgaacaggtagtacagcgcccggttgcccgggaaccggtagcgggccagcacgtacgccgccatcgcgcccagcagcatggtgccggccgtgctgaccaccaccacgaacacgctgttcaggaagtactgcccgatgtgcgcctcgctccaggcgtcggcgtacgtcttgaacgagaagtgcgcgggcagcgagaacggcttgcccaggaagatctcggtgttgtccttgaacgaggccagcaccacccagatcagcgggccggcggtggccagcgcccagaggaacagcgcgatgtgcgccacgccgttgagcgggctgattctgcgttccttgtccgcggcggcgggtttcgcggcgaccgcgggtgcgttggttaccaggttggtcatggtgatctccgcggtcaggcgtttgcggcgtcgcgacgggtgacccgcagggtcagggcggcgaacgtcagggtcaggaagaacagcacgacgccgatcgcggaggcgtaaccggcctgcgagttctggaaggcgttcaggaagatctggtagctgagcacctgggtcgcgttgttcgggccgcccttgttcaccgacatgatgttgaccagggcgaacgcgtcgaaggcggcgataccgaggtagacccaggcgacctgcagggtgccccagagcagcggcagggtgatccggaagaacagggtgatcttggtagcgccgtccagcgcggcggcctcgtagatctcctgcgggatgttgcccatgccggccgagaagagcaccacgtagaagccgaccgcctgccagaccagcaccgccaggatgcaggtcagcgcgaaccgctcgtcggccaggaacaaccagggcgaccaggaggacgggaacaggccgttgagcatgccgccgtggtccgagccgaacacccggccgaagatcaccgcgacgatggccagggccagcagctgcgggaagaagaagatgatccggtagaccttggagccccagatgccccgggtcactccgcccttgctgcggccgccgacgttcagcaggaacgcgaagaacagcgcgatcgcgatcgtcacgatcggcaggaagatcagcaggaagacgttgtgccgcagggcgatccagaagaccgggtcgtcccacagcttcacgaagttgtcgaagccgatgtacttgaacccgccgaagcccgaccagtccgtgaaggacagctggaacatctgcaggtaggcaccgaccacgaaggtcagatagagcgccagcggcacgacaaggaaaccgatgatgaagggatacttgccgtgccgcatgacgtcctacctaggggtgagaataagccggatcaggaacgggtgaacttggtgatcgaggagtccttcgcgacggcctgcgaagcggcctccatcgtgtcgcagaacttctgcgcgtcgccgcccttgaacatcagctggttggcggcctcgcgggaggcgtcgtccagcttcttgtaccaggtgtcgaacaggtaacccatgaagacgtcctggccggccttgctgagcgcgtcgttcgcgctggtcagaccggggctgatgacgacgccgtcagcggcgccggccaccacggtcagcgacttggtgagcttggtgaactccagcgccgccttcttcgacagcatggtgcgcaggtactccttgccaccctgcgggttcttgcccttggccgccgcgaagtagatctcgccggccgcggcgttgatcgcggtcgccgggagcttgtccgaggtggtgacgctcgggaacgccatcatcgcgtactcgaaggtggccggggtgctggccgcctgctcgttctccaaccaggagccacaggggtagaacgcgaccttgtcctggtcctgctgcagctggacctcggtgtgcttgaggccgaggaaggacttgtcgatgtacttgttgccgacctcgccccacgccttggcggcctgcaggaccgcgtcgttggtccacgcgcccggcttcaggttgtcgatgtccttgagcacctgctcggtgccgatcttcgcggcgctggtcatgatcgcgcggaccatgtagtacgacgcgttggcgcccgcgtagccgaacggcgtgatgccggccgccttgatcttgtccagcagcgcggtgaagtcggcccaggtggtcgggatggtccagctgttcttggcgaacagcttcttgttgtaccagaggccgaagacggtgaaggagtagttcaccgcgaacggcttgccgtcgtaggtgccctgctgcacggcgcccggcaccagcgtctcggcgaccgtcttgccggtgatgtccagcgacggggcggcgaacaggtcggtcaggtcggcggcctggccggccttgaccacggcgccgaagtccatgatgtcggagcccgagttgttgatcatgtccggcgggttgccgccgttgagccgcggcttgatcgtggtggagacctgctgggtcgccgagtaggtgaccttggcgtccggccacttggtgttgaacagcggggtgtcgacatcggtggcgtacttggtgcccagaccaccgtcgaagatcacgatctcgacgccggccttcgggtcgatgcccagcgggttgtcggccgacttggtgccggtcgcctgcttggtggtgccggagtcgtcggagccggcacaggcgctcaggaagctgacgccgggggcggccaccagaccgaccgcggcggcacggcggagcagcgtacgacgggaggtcgttatctcagacatcggtgtcccttcagaaaatcgttggttgattcagcccttgaccgcgcccgcggtcagtcccgaggcgatgttgcgctggacggcgaggaagaagatcacgaccgggatggaggtgatgatcgagccggccatcagcggaccccagtaggtgccgtggctggtctggttctgcatcagccaggccatcaggttctggtggtcgttgtcgttgagggtgttgatgatgatgaactcgttccagacctggatgaacccgtagaccgaggtcgccaccaggccggggccggtcagcggcaggatgatccgccagaagacctgaccgcgggtgcagccgtcgatcatcgcggcctcgtccagctcccgcgggatgccggcgatgaaaccccggagcgtccacaccgtgtagggcagaagcaacaccacgtagaccagtgtcacaccgatgatcttgttaccgatcagatcggccttctgcagcatcaggaacagcgggatcagcagggcgacgaacggtaccagttgcacggccaggaccaccaggatgatcgcccgccggccgtagaacttgaaccgggccacggcgagcgccgccaggaagccgaccaccagtgcggcgagcaccgccatgcaggtgatctcgatgccgttgatcagcgaggtcttgaagcccggggcgttgaacgcggacttgtagttgtccagcgtcggcgattcgggcaggaacgtcggcacgaagctggaccactcggtctgcggcttgaacgaggtgatcagcacccagtacaccgggaagaacatcacgatcgcgaacagcaggccgcccgcgttggccaggaagttgcccagcggggtgcgcccgacggtcatcgtgccgtcggcgtgccggtcggccttcttgcgacgcggcaccgtggtggcgacgactgccatcagtccacctctccgatcttgaacatctgccggatgtagaccgtcatggcgcccagcagcagcaggatggtgagcaccgcgatcgccgagcccaggccgtacttgttctgcgcgaacgcctgcgcgtacaggtaggtcgccagcgagtggaactccggctccggcttgccgtcgcgcagcacccagctctgcgtgaagagcccgaagttccagatcaccgagagggtcgtgacgatcaccagcagcggcttgaggatcggcagggtgatgttgcggaacgactgccaggcgttggcgccgtcgaccgtcgcggcctccatcagctccttgggcacctgggtcaggccggcgttcagggtgatcgcgaggaacgggataccggcccacagcacgcaggcggtgatcacgatccagccctgcgtgggcgtgtagaaccaggagtggttctcgaagctcaccccgggcagcttgtcgatcagatagttcagcaccccgacgtcggagtcggtcatcatcttgaagatctgcgcctggaccagcgcgggcagcgcccagacgaacatcatcgcgatgatcatgagcagtcgcacggtcctgccgacccggcgcatcagcagcgccaccccgaggccggacagcacgctgagcaccaccgacaccgcggtgaacaggaccgtgtgccccacgaccgaccagaacgcggagtcggagagcgtgtcgatgtagttgtcgatcccggaccacggcgccgctgccccggtccagagctgcttgacaccgaacttctggaacgagatgaccagcatccgtccgaacggataggccagcagagcggccagcagcagcagggccggggtggagagcagccacggcaggccggagccttcctcgctgccgcgtcgcgcacggcgccggccgaccgggcgcttcgcgccggatccggccggcccggtgggcgtgcgggtcgccggagaatcgaccgcgtacatcagctttcctttctgaccgaaggaaccgagggggtacgccgcccgcccgtctcgcgaccggcgggcggcgtccggatcagccgttgagcgtgtcagcgatcttctggtccgcggcggcggtcgcgtccgcgagggacttcttgccggtcaggatgtccgacagcatgtccttgaggatgttggccttctccacgtcggcccacttgccggaggccggcacggcccagctgttcttggcggcctcggccgggacggcgagcgtcgggttcgcggaggcggcggcgtcgagcacggcggtcgcgttcggcagtgcgccggccttggccaggccggccatcgaggtgctgtcggtgaagtacttgatccactgggcggcgagctcggagttcttgctcttcaccgggacaccgacgttcgagccgccgagcagcgacgggatgcccggcatcggggcggcggccagcttgcccttgaccttggtcgggaccagcgccgagttcgggtcgttcgggtccttcttgacctgctcggccgaaccctgctcccagccgttgccgtagaacatgccggcgttggcctggctgaacaccaggtactggtcggcctcgtccttggtgacgtccgccttcgagtacttcttcaccagctcgacccacttctgcagaccggcctgcgaggccgggctggagagctggccggtccacttctcgccgtccttcttggcgatgtcaccaccgttggccttgacccaggacatcgccgagtaccagtagcggcccggcatgtagacggcgccgaacttcgggtccttgttcgcggcctgcaccttgtcggcgtcggccaggaactcgtcgtaggtcttcggcgcggcggtgatgccggccgccttgaacaggtcggtgcggtagatcaggacccgggcgccggcgtagtacggcacgcagtaggtcttgccgtccgactcgcacgggccggagagaccggtcagccagctgtccgagttctcgaagctcttcttgtccagcggggcgaaggcgccggcgtcgacgtacttcgggaactgggtgttgccgagctcgaccacgtccgggacgtcggtgccggccagcgtggcgtccagcttggtgagcacgttcgcccactgctggtactcgacggtcacgttggcgccggtggcgtcggtgaaccgcttggtggcgtcgtcgacgacacccttccagccgctctgggcgtcgaccatcagccagaccttgatggtcttgcccttgccgtcgaccttgccgttggccgaggtggtcgagctgtcgtcggacttgctgccacacgcggcggcgcccagcagcgtcgcggcgagagccgcggcgacggcgatcttgcgcttcacaattcctccaggaggggtgtcattcaaaggcggtgctgagtcaggtgtctttgaccgctttgtgcccatggaccgcctgagcggtgcgctggaaagcggcgtgcgagcgttcgtgggtccgctgcgcgacggccacgtacagcagatcgaggaccaccagctgggggtgtcgcgcggagagcgcatccggccggaaggtggtcgcctgggtggcggtgagcaggacgatgtcggcgagctcggccagcggggaacgggggaagctggtgagcgcgatggtggtggcgccccggctgctcgcctcggcgagcagctcgatcgtctcgccggtctcgccactgtgcgagatgccgagcgcgacgtcgccgggccgggacagcgcggcgctggccagaccgttgtgcacgtcggtccaggcccacaccgggatgccgatgcggtgcaaactgaactgcatctcctcgccgaccagcgcgctgccgctggcgccgaagatgttcacccgcggagcggcggcgatcgccaccgcggcccgctccacctcggccaggtccagcagcgaggcggtgtcgtgcatggccctggtgtcggcggccatgatctggccgagcacccgctccagggggtcgttgggctggatctcccggccgatgtccaccgtccagccggccgaccgggcgcgcccggtctcggcggcgatgcccagccgcagatccgcgtagccgtcgaagcccagcgcgcggcagaaccgggtcaccgtggccggggacgtcccgctgcgctcggcgagctcgacgatggtggcccgggaggccgccgcggggtcggtgaggacctgctcggcgacgcgctgcagggcaccggtgaactccggcagcagggtgcggacccgcaccagcacgccgtcggaggccggatgatccatggggtcgctcttctccttggcggccctgggttcgccgcgcacccagaaaccctgttccagccggtcccgcgaggtgtggtcgctcccgcccggggcagcctggtcgcgggccggtgagaacgcgaccgcggtcttcgcggtgccgtccatctccggctcagccatcggacaccctttcaggaaggactgtttactgtcgcggtaaaagttcttactaaccgcccccctgtgtcaagaccgtgggtgaagttttcaaaccgttacctgacctgggccgatgaacgcgtgtttcggcggagccggatgacggccatcgatccggaaataacccttacggcgtgagccgtatcacatgacccagaaagaaccgatttgtggcccaccattcggccccgcacaggccgatgaacgggcggctggacctcccccgatcgggcgaataccgtgactccgcgaaatctcgccgttactctcgaaacaagatcaaaattatttccggtacgagcggtcccacctgccccttcgcgccaccgatcgtcccttcgccggtcatcggcgcgatgcgacgccggtgatggcagcgctcccacccgccgcgggcaggaaaaagccgcccacgatgtcgtgggcggcgggacggtgaagtcaggaagcggtggcccggatcgcctcggcgaaggcctccgagcggtgctcgaagttgcggaagcgcccgtaactgggcgcggccggggacagcagcaccaccccgcccgccggcgtcacctcgcgcgcgagccgcacggcgtcggccagatcctcggccggcagcgtggtgaccttcggcaggccggacaactcggccaggatccgcggcccgctgtccggaagtccgatcacggtgagttcccgggacgcgaggaattctcgcaacggagcgtagtcaagaccgcggtcggtgccgccgagcaggacggtcagcggccgcccctcgtaggcctccacggcgtgcatcgcggagtacggcgaggtggacagggtgtcgtcgacgaaggtcaccccggacgggtcggcgatctcggtcagccggtgcggcaggcccgggaacgaccggaccgccgcctccaggtccgcccgcaggcccaccacgtcgacgcccatcccgtccagcaccgcgagggccacgcacaggttccgctcgttgtgccggcccaccagcgccagcgcggaccgcgggaagagcgggtcgtcgctgcagaacacggtgccgtcctcgacccggaaccgggagtcgtccgccgcggccgggaccggcgggaaaccgctccggtcgctcaccccgcggatctcgtcgcgcagccgctcgtcggccccgttgaccacgatcagctccggcccgtgggccaggatgttcagcttgtcgcggtagtactcgcgctcgccgccgtgcgcgtccaggtgctcggggaacagcgaggtgaccaccgcgacccggggcgagtcggtcaggtcggcgcactggtagctggacagctccagcacgtagagctcggccggcggcaggtcgagcagcggcaccccgatgttcccgccgtacgcgttgggccggccgaccgccgcgagcaggtggctgatcaggctggacgtggtgctcttgcccttgctgccggtcaccccgacggtcgccgccgcgtggtcggccatccagagggcgctgccaccggtcaccggcacgccgcgggtccgcagctcggccatgaaggggtgggtggacggcaccccgggcgagcggaccaccacgtcggcgctggccagggcggcgaaggcgtgctcgccgccggccagcggggcgcgcgggtcgttccacgggtcgtccaggtaaccggcgccgtcgttgaccgcaatcagccgggacggctcgtgggcggcgatcgcgccgaccgcggcccggccctcccggccggtcccccagaccgccaccgatcggccgcgcaggtctgccaggcgcacgtcgtccccctcaccatcgtccaaatccggcttatgccgagaaaatcgagcgaaacggcccagccgtgccgctcgccgaaccgaactaatattgcccgtcggccagaagacaggagttcccgggtgcagttcgacgtcatgcgcttcccctcgtccgcgttcgacgagacgaccggggtcgccacgttcgactacgtgctggacgggccggagccgctgcgcttcaccgagacgatcacgctgccggtgcccgcggcgccgcgcgacaccgccgccctgcgccgggtgctggagctgctgcacgtggtcgccggggtgagctactacaaggtcggcgccccgccccgggtggtggcgccgcgcccggtcgcccccgcggtggccacctggttcacccgggtctacaccgacgggctcgccgagtacgcgtaccgcaaccggctcccgcacgtgctggagctgaccgtcgagacgcccggcacgctgcccgcggccgccccggtcgaggccggcgggcggccgctgtccgcggtcggcggcggcaaggactcgatcgtcaccctggagatcctgcgcgcggccggcctcgaccccgtgccgttctcggtgaacccgaacccggtgatcgagaacgtgaacgccgcctccggtctgcccgccctggccgcccggcgccgcctcgacccgcggctgttcgagctgaacagggccggcgcgctgaacgggcacatcccggtcaccgcgatcaattcgctgatcgcgatcgccaccgccgtctggcacggactgggcccggtggtgatgtcgaacgagcgctccgcgtccgaccccaacctgatctggaacggccacgaggtgaaccaccagtggtccaagggagtactcgccgaggggctgctgcgggacgcggtgaccgcgcacaccggcctcgtcgacccgtacttctccctgctgcgcacgctctccgagctccacatcgcgcaactgttcgccggtcacacagcgtacgatgatgttgttaccagctgtaacaaagcgttcaagcttcacgacccgacggcccgctggtgcggcgactgccccaagtgccgcttcgtgttcctggcgatggccccgcacatgccgcgcgaacgcctcgcgcacatcttcggccatgacctgttcgccgacgcggcgcagacacccggcttcctcgaactgctcggcatcgacgcgcacaaacccttcgagtgcgtcggcgaggccgaggagtgcctggtcgccctctccctgctcaccgacgacgcgccggtgctcgtcgccctgcgcgccgcggtccccccgtcggcgtgggacgacgtctcgcacagcaacgtcttcaccccgggcggcgagcaccacatcccgcccgcctacctgaaaatcctgaccgccgcgctctgaccaccatggagatccggatgaccttcagccgcaccgagggccacgccttcacggtgtgggtggaaccggaaggtgactgcgtcgaactgccgcaggcacagcgcgcggtgttctccttccgggggccggacggcatggacgcccagttgacccaccaccccgaccggctcgtcatctggcggccaccggacaccgaggtgtggctgtcggtcgacggcgacgagttccaccaggtggccgggttcgccgacatccccgcgcccggcctggactcctcgggtgcggggctgagcgtgccgatccgggacatcgtcgaagaccttttccactgagccgcggtcaggggcactgcaggacgagccaggtgcggtggaaggcgtgggcggccagatcccggtggcggatccagaagtagaggcggccggcgtcggcccacgcccagtccatggtgtcgtcggtgtccagctgacacagcagcagccagtcggccgcgcccggggtcagttcggcgacccgggcggcttcacggccggccggattgccgtggtggacgccgttcgcggcgagctggcactccaggcgcatcgggccctgcagcgcgtcgggccagccgaagacgcggtgcagcgggacgccgtcgtcgttctccagggagccgtagaaatcctggacccggtcgtggcgctgccaccggtggtgctcccgggtggcgtcgaccggcggctcgtcgatggcgggaatggtgaggacgggggtcaggcgggcctgatgggcgacgaacgactccggctcatccgccatcgctgttgtggagaacgaatccgtcgttgcggtgagccccgcggcgagcggcggcgcggtggcgcaggacagcggggtgctggagacgtgccagtggccggcatccgccggatcgaagccccagcgctgctcccgccagtcgtagaagaaaccgagcagcgtccccggcggcagcagcggctccccgaggcgggcgttgacctcgtcggtgttcagctgaccgaggaacgactgcgggttgcccgacggcgaatacggccaggccgcgcccggcgggagcaggggtacgccgccgagccgggtgtcggtggtgtccggggcgcattccgggccggtggtcaggcgcagcgaggacagggccgcggcggccaggaccggacgcaccgggtcgggggccgcgcccagcaggtggtcgtcgatctccaccgccaaccccctccggccggggacggacggcccggcacgaagctgagtctgccccgcccacggagggcgggtggagaaatcgggtgctgtcgacgtacccgagcggcggtgacggaccgcgccgtcattccggggcgtcgtggtggatgcgggccggggagacaccgagctggtgcagcgcgagggcggtggcggccagcatcagcggcggcccggccagatagacctcgtgccgggaccactcgccgtaggtcgcgaccgcgtcggtgaccaggccgaacgggtacggtcccgggtcgccctcggagatcaccgggatcaccgtggcacgcggggcctcccgggcgatcgccatcagcgagtcgacgtcgtagagctcccgcaggttgcggacgccccagaagagcaccgccgggcgcgggtcgcggaccgccgcgagctgggccagcatcgccttcatcggggccaccccggtatccccggcgatcatcagcacgccgcggcccggctcggccggcagacccatgtcgccctcggcgcgggtcacccggacccggtcgccgacccgggtgtcgtgcaccagcgtgccgctcaccccggtctcggttttcgcccgcacgtgcaactcgatcacgtcgtccagctgcggggcgccggccagcgaatacggccgccagatgccggggaccgcgtcgacctcgacccgcgcgtactgccccgggcggtacggcatcggcaggaacgggcgcagccggaccaccgccaggtcgggtcggcgcagctcgtggctgatcacctcggtgtcccagacggtcggttggtaggcgatcagcgtgccgccgtgcaccagccactcgtagacgtgctgccacgtccaccgccacgcctgatcgaaatcctgccgccagacgcccggcgccatcccggcccgcaccgcctccgccagcgccgcgccgaccagctgcaactgcttccactgcacgccgcactcggccagggcggcgccgagccggccgcacccggcgaccaccgcgggcgggtcgtcgagccggtggaccagccaggtcagcgcgcgggccagctggcccgcctgcgagccggcggtgccgggcagcgcggtcagcaggtcgggctgggcctgcagcagcgcctcccacagccgggcggccacctcatcggtgccaccggcgaacgtcagactggtgctgagcaggcgttgggtgtcccgcagggccatcgtgtcgcccgggtccatgccgtccgcggcggcgctgcggcgggtggtgttacgggcgaaatgcgcggcgtactcggccggggtgaccgacgggaactcggtgccggcgccgccgatcggccgtgccttcggcacgccgggcacgctcggcaccggggtcgccggcccggcggggttgacgccggtgatggggttgacccgattgacgggtacgccgtaggctagctagctagcgggacggtgtcgccggacacgaccggatggccgatgcccgacgggtatgccggtgtccccgaccgggcggccgccgggctgggcgccggctccgggtccggatcccgtttcgccgcggcgatctcggacagggcggcggcggtgtcggccgcacccgcggcggccgcgtcgggggcgctctggcgcagccggatggcgcgcagcagggccagcagatgcgggtctgatcccggaccagacgacatctgacaccccccgatcagcggaacaacgcgaaccgtacaaccgtactgcggccggcgccgggtggcccggcgccggtggtggcacctgcgcccatcttcccgcacgtcccgccgatcgacatccactcggccgccacagatctccctattcagggtctccggcccgacccgatagaccacgcacggccgcaacgggccgggcgggacggtccggtcctcgaagtcggcggccggatcgtggaccatgccgagccgctccatcacccggcgggagcggacgttgccgcgcaccgtgatcgccaggatctccggcaggtccagctcgccgaagccgaagcggagaacggcccgggccgcctcggtcgcatacccgtgcccccacgcgccggcggccagccgccagccgacctccaccccgtccaccggggcgtcctcgtcgaccgggtcgagaccggccatcccgacgaactcgccggtcgcggtcacctcgaccgcccaccagccccagccccgggtcaccatggccccgcggaaatactcgatcgacgcggcggactcggccagcgtcagcgtgccggggaagaactcgcgaacccgcgggtcggcgttcatcgccgcccagaccggcaggtcggcgtccgtccactggcgcagccgcagccgctcggtgatcagttcggtggtcatgccggacgtttctacccccggtgcggcgggggcgatcggcggggtcggcagaatgatcgtgtgcccgccatcgttatcaccgaccccgacgacccgcgcatcggtgactaccgcgccctcaccgacctcgaactgcgcacccggtgggagccgccgaacgggctgttcatcgccgagggtgagctggtcatccagcgggcgctgcgggccggctaccggctgcggtcggccctggtcgacgagaaacgcgccgaccagctcaccgggctgccgccggacgccccgctgtacgcggcggcccccgccgtcctggagtcgatcaccgggttccacgtgcaccgcggcatcctcgcctcgttccaccgccgcccgctgcccgagcttcccgacctgctcgccggcgcccgcaacctggccgtgctggagggcctgaacacgcacaccaacctgggcgccctgttccgcagcgcggccgcgctcggcatcgacgcggtggtcctgtcccccagttgcgccgacccgttgtaccgccgggcggtgcgggtcagcatgggcgaggtgttcgccatcccgtacaccaagacggaaacctggccggagccgctcaccacgatccgcgacgccggcttcaccctgctggccatgaccccggccccggacgcggtcgccctccgcgacctcaccgcggcgcagcgggaccgcccggcgctgctgctcggcgccgagggtccgggcctcacgccggccgccctcggcgccagcgacgtccgggtcgccatccccatgcacaacaacgtcgactcgctcaacgtcgccaccgccgccgccatcgccttctacgaactgacccgctgagccggccgatgaccgacggccggcgccccgcccacggccagcggatcggaacgcacaacacacaacacgaccacttccactgccgggcctcgatcacccggccacaccgggtcgacgcggtcccgcccgccgaagaccggcgcaccggccgccacccggaccgggaaccggccgcggcggccgggggacggcggcccgggcacccggccgccgccggcaaccaccgccggctcgtccctgacaccgcggtgtccgcccgtcgcccgcgggaggccggctcgcgaaacaaccaaccggtcaggttcgggggaccagccggccacccgtccaggccaggcccatgccggcggcgagcagcaggagcgcgcccaccgtcgggagcggcttgaccgcgtagttgccggcgcccagggcgaccgcggccagcatcagcaggacgccgtcggccgggttgaccagctgggaacggaacacggcccagccgaggagcagcatgccgccgccgcagacggcgcgggcgacgtcgagcaggatgcggacctggccggtggtgatggacacggcggcggtggcggtctgttccgggagggcgaccagcggcagcagcagggtggcgccggccagggtgacgagcaggccggtgagggcgacgcgccgggtgcgggagccggcgagcaggccggccagggcgatcagcgcgatgctggtcagccagccggcgaggagtcccacggggagcggaccgggcgggacgttgacgccgagggtgaaccaaccgtagaggaccgcggcggcgggcagcgcccacagggcgagccgggcgaagcgccggaccgaccagatccagacggcgtcgcggaccggtaggaggtgatggtcggtggcccggccggtcggggtcgcggcgccgacccacgcgggggcgacccgcagggggcggccggacgcggtctgacgatggctgatgctcatggttccgcctcgctcgcaggggcaacacgccgagcggccgggggaaaccggtcggaaatccgagtcgaagcatgccaaattcgcagggaactgtgaggcgtatctcaggaaattcctggaaatgccgggcggcctgcccgcttcggacaggccgccgacgaaaagaccggaccggtgggctcaggcctggtgctgctgcccctggtagtcggccccacccagcgccgacgacggcggcacctgcggggacgcgcccagcgccgcggtgacgtccggatccgccgagacctgggcctccgcctcccgcacctcgtcgttcacccgggccgcctcagccgccgccgcctgggccgcggccgccgcctccagcgccacctcgtccgagtgcacctcggccagcggcacgtccccgaccatgttggcgagcccgccgagcgcaccgcccagcccctccagggccttggtcagctcggtcggcacgatccacaccttgttcgcgctgccgttcgcgatctgcggcagcgcctgcaggtactggtaggccagcaccttctgcgacgggttcgcctggtggatcgcgtcgaacacggtccggatcgccttggcctggccctcggcctgcagcacccgggactgccggtcaccgtcggcgcgcagcaccgcggcctgcttctcaccctcggcggtgaggatctgcgcctgcttgtgaccctcggcgttcaggatggtggcgcggcgctcccgctcggcgcgcatctgcttctccatcgagtcgcggatgctgggcggcggctcgatcgccttgatctcgacccgggtgaccttgatgccccagcggccggtggtctcgtccagcaccgtggacaggtgccggttgatctcctcgcggctggtcagcgcgcgctccaggtcgagcgagccgatcacgttgcgcagggtggtgacggtgagctgctcgatcgcctgcaggaagttggcgatctcgtaggtggcccggaccgggtcgacgaccttgaagtagagcaccgtgtcgatcgagaccaccaggttgtccgaggtgatcaccggctgcggcgggaacgacacgacctgctcgcgcatgtcgaccttgctgcggaccgcgtcgatgaacggcaccagcaggttcaggccggggctcagggtgcgctggtatttgcccaggcgctcgaccacgtccatccgctgctgcgggacgatccggatggaccggacgatggtgatcaccgcgaacaacgcgatgactatgaccagaactgcgatgacagctcccatggcgcctctctatgaaaaaacgaacacgaagtcgatcaaacgtcgggcaggtcatcgtgccagaccagcgccgtggcgccgcgcacggtgacgactcggacgcgctcgccgggctcgaaggtctccttgccgtcgaacggccgggcctgccagatctccccgtcgatccggatctgaccgtggccggcgtcgacggtctccagcacggtgccgtggtggccctccatcgcctcgatcccgaaggccgtgtcaccggtctccagggcgggccgggcgtgccggacgatgatcgggcggaccgccgccacggacagcccggagaccacggcgaagacgatgacctgcaggagcaccggggcaccgagggcggcggcgagggcggccgcgccggctcccgccgcgaagaagatgatcaggaaggtcgcggtgaaggcttcgccgatcgccagggcgatggcgaggatgatccagagtacggctgccacatcaacgatcgtgtcacgtccgcgcatccgcggcgatgcctcgtgcacacgtagccgatcgccgtccggccagttagacccgtcagtcgcactgcaggaggatgccgaccgtgacactgcttccggagaccgcccgccgggtcgacgagatcgccgcccgggcccaggcgcagggccgggcgccgtcgctggcgctggcggtggtgcgcgaccgcgcggtgctgcacttcgcgggtgccggggagacgccgcggccggatcccaagacccagtaccggctcggctcgatcaccaagacgatcaccgcgacgctggtcatgcagttgcgcgacgaggggttcttcgccctcgacgacctgctctaccgccatctgccgggtaccccgatcggcggcgtgacgctgcgccagctgctcgggcacatctccgggctgcagcgggaaccggacgggccgtggtgggagcggcgggacggcggtgacgtggcgcagttgctggccggcttgacccacgagaagctgaccggcccgccgttccgccgctaccggtattcgaatctggcgtacggcctgctcggcgcggtggtgtcccgggtcaccgggcagagctggacggatctggtcaccaagcgcgtgctggatccgctgggcatgaagcggaccagctatctgccggtggagccgttcgcccgcggctacgtggtccacgcgctgggcggcacgttgcacgaggagccgcgcccggacgccggcgccatggccccggccggccagctgtggtcgacggtgaccgacatggcgaagtgggccggcttcctggccgatccggcgccggcggtgctggcccgggagacggtcgacgagatgtgcagcccggtgaccatcgacgatctggagtcgtggacgtccgggcacggactgggcccgcagctgttccgggtgggtgagcgggtgtacgccgggcacgccggctcgatgcccggctatctcgcgcatctcgccgtgcaccggcgcagccggttcggggtggtggtgttcgccaacacgtacgccctcgccggcggctccctgatcaaggagctgagtctgcggacgctgaccacggtgctggacagcgagccggcggcgccggtcccggcctggcagccgccggcggcgccgaccggcgaggccgcggagatcagcggccgctggtggtggatgggcggcgagttcgacatcgccccggacggcgacggcctgacgatgaccggccgcctcggccggacccggttccgccgggaggcgccggaccgctggcgttgcgtctcgggcagcgacgagggcgaggtgctgcgcatcctgcgggctccggacggcacggtcgacaagatcgacattgccaccttcgtctacagccgcgacgcccgggatctggcctgacttccgatggcggcggtacgccgttcgccgcgcccgtccgtgcccgcccggcccgcccgcggcggtgcgccggcatcacccgcccgccgctgccggagcccgccctgatcgcggggtgatcgccgactcccgcccgcggctgccggaacccgccccgatcgcggagtgatcgccgacccccgcccgcggctgccggaacccgccccgctagctagctaggggcgagcccggccgccacggtcgccatgccgagccagaccagcggccgcggcgccggcccgcccagccccatcccggtcagcgccgcggcgatcggcgcgagtccggtgagcagcccggcccgccccggcccgatccgggtgacgcaggtgtaccagagcacgaacgccaccgcggtgaccgcgaccgccaggtacgccccggccagcacgtcgccggcgtgcagccggagcaccgcgcccggcccctcggtgaccagccccgccgcgccgaacagcacgaccgccatcccggtggcgtgcacggacaccccgagcgggccgtgccgccccagcaccggcacggcgagcaaggtgaacagggcttcgcagaggaacgtgacgacggcccagaacaccccgatccgatcggcccggccgagcccctcgacaccgatcgcgccgagcgtgaccactccggcggcgagcagggtgcgggcggccggccggtggccctgcagcagcgggccgcccgcggcgagcaggatcgggacgcaggcgaccgcgacgccgaggaccgccggttcggcgtgccgggcgccgtgcatcagggcgatgttgaagaccagcaggccggccacggtgacgccgagcagccaccgccattcggcgccgcgcgggcggcgcaccggggtgcgggtgcacgccgaccagccgagcagcagcaggcaggccaccgcgtagcgcagcgcctgcacggtgagggcgggcgcgccggcgaggtggccggagaccgcgacgctgccgccgacgaaggtcatgccggccgcgccggcgaggatcggtaacgccttcatgcggttcatgcttctccggcgtatggtccttttcgaggaccaatggcgaggcgatggaggggaccaatctccggttcggacttcctgcagttgcgcaccgcggacgccccggccaaggggttgaccggctggctggccgacggcctgcggtccgcgatcgcggccggccggctcgccccgggcagccggctgccggccacccggctgctcgccgccgagctgggcgtctcccggggcgtggtggtgcaggcctaccagcggctggtcgacgaggggctggccggcgcgcgcaccgggtccggcacggtggtggcccgggacgccgcggtcgcgccccggccggccgccgaccgccggcgcaccctgcacgagctgcggctgcccctgtccaccccggacggcatcgacctcaacctctcccccggggttcccgacctggccgccttcccccgggcggcgtggctgcgggcggagcgcgcggtgctggaccgggtcaccgcggccgacctgggctacggcgacccgggtggcacaccggtgctgcgggccgccctggccggctggttacggcgtacccgggcaatccgcgccgaggcggacgacatcctggtgtgcggcggcgtcgcgcaaggtcaggcgctcctcgcgcaggttctgcgggttcgcggcgaagccgtcgtggccgtcgaggaccccggctcccggggcagccgggaccagctggcgtactggggggtgcgcggcgagccggtgccgatcgacgagagcggcttgatcgtcgagcagctgcggcgaaccgggctggcgaccgcgctgctcaccccggcgcaccagtttccgaccggtgtcgtgctcgccccggaacgccgccgcgagctgctcgcctggggcggcctgatcgtcgaggacgattacgacgccgaacaccggtacgaccgtgccccggtcgccgcgctgcagggcagcgccccggaacgggtcgcgtacctgggcagcgtctccaagtccctggcacccgggatgcggctgggctggctgatcgcgccgcgccggatgcaggccggcctgctggccgccaagcacgccagcgacctgggcagttcggcgctgccccaactggtgctggccgagctgatcgcgaccggcgactacgagcggcacctgcggaccgtgcgggcccggcagcgggcccgccgcgacgcgctgctggccctagctagctagagcgggcccgccgcgacgcgctgctggccgggctccgggcgcacctgccgcgggcccgggtgcgcggcgtggcggccgggctgcacctgctggtggaactgcccgccgggaccgacgacgtggcggccgccgagcggatccgggagaccggcgtgctggtccacccgctcacctggcaccgcctgctgcccggcccgcccggcctggtgatcggctacgccggtcacaccccggaccgcctcctcgacggcgcggcgcggatcgggcgcgctatcccagcacggtgacgtggtcgatcaaccgctccatcgcgttgatcaggggcgtctcgacgtccttgtaactgtggacgcaggagaggatgcgacgccacatgtcggccggctcgcggacgccggccgcctcgcagacgccctccttccacggacggcccggcgggatcaccggccatgcgcgcagcccgacccgctcgggtttgaccgcctgccagacgtccacgtacgggtgcccggtgatcagcacatcggggtgggtgaccgacgccacgatccggctctccttggagcccggcaccaggtggtcgaccagcaccccgagccgtcgttgcggccccggccggaactcccggacgtgcgcgtgcaggtcgtcgatgccgtccagcggctccaccaccacgccctcgatccgcaggtcgtcgccccagatccgctcgaccagggcggcgtcgtggatgccctccacccagatccggctggccttggccacctgggcggtcacccgggccaccgcgatcgacccggacgcggtcacccggcgctgcggcgcgaccgcccgcggagccggtctccgcagcgtgaccgtctgcccgtcgagcaggaacgcggccggggcgagcgggaagttgcggcgcttgccgaaccggtcctcgagcaccaccgcacccagctcgaacccgacgaccgcaccgcagaaaccggagtcggcgtcctcgaccaccaggtcgggctcggcatccacctccggaatggtcttccgccggcgccagttgccggccatcacgtcctccccatacatgacccgcacggtaatacgtcctttcggacacgcccgggtgacgctccgagtcgcgacaaggttccgggatgccacgtacccttgctcgcatgtcacccgcagcagatgcggccacccgcaccgcacaccggtccacccgtttcgtggcctgggtgcgggcctggcgggccgggctggtcccgttcgacgacctggccgccgagatcgccgaggacgaggagcacctcgtcgccgaagcccccggcacctggaccgacgtgccgctcggccagggcctgccgatcttcgcgaagctgcaccccgacgacatccggctggtcctgccggtccccggcgacccgcgcgggctgcccggccccgggccgctgaccggcgccgcactgctcgccggcgaggccgtggtcaccccggagttcggcgtggtgcccgaggtgcggcggcacacgtccggctccggtgtggagttcgagaccgtggtgtggcgggtgctgccggcccccgggcaccggccggtgttccagatgggtgccgccgaggccgaggcgcagctgaccgccgcgctcgccgaggccaccacccggctgaccagactggacgtcgcgcagtggaaaccggagctggccggtgccctgcagcagctgcgccggccggagagcacggccaccctgccgcccggcttcgacccgcgctcgcgccggctgttcgcgcgggcgagcgtgctcgcccaggtcctcgcgctggccgggacgaacgcgccgggcggcgcggtcaacggctacgaggcgcagcagcgcgacgaggcgctgcggccgctcaccgcggcctgccggcaggccctggtcgcggcctgcaacgcgccgctgcacccgtgaccgccgaccggcacgcgcactgcacctactgcggggcccggttcgtgccggaccaggcgtggccccgccgctgcgcggcgtgcggcgagaccacctaccgcaacccggcgccggtcgcggtcgcgctgcagccgatcggttccggactactggtggtacgccgcggcatccccccggcgcacggcagtctcgcgctgcccggcggcttcatcgaatacggcgagagctgggccgcggccaccgtccgcgagctggccgaggagaccgggctcgaggccgatgccgcggaggtacgcctcttcgacacccgcagcgcgccggacgggacacttctcatcttcggcctgctgcctgaactcgcggacggcagcgggctccccacgacgccgccgcccgaggaggcgctcgggctcgaggtgctgcacgagccggtgccgttgggcttcagcctgcacaccgaggtcgcggggcgatggttcgacctcagtcgatccggccggctctgaccagctcgccgaggaccagccggatcgccggagcgcaccggtccgcgtccgcggagctgaaccaggccagttcggcgatctcgttggccggcgccgggacgccgtccgcctccccggtgaaacacaccaggcggacccgggtgccgggcggccggttgtgggccggcgcctcgaaggtccggaagaaccgcgggtccccgaccgtcaggccgacctcctcggcggtctcccggacggccgcctcggcgtcggtctctcccggctccggtttgccgccgggcaggtagaacgcatccgacccgtgcgcccgcaccaccagcaggcgccgatcgcgcacgcacacccaggcggcggcgaccacctcacccgtgcccctgtccgtcatgccgatctctccctcaggccagcgtgaacggggcgccggcctcgaagcgggccaggtcgtccaaagtccgccgggtgttcggcccggccgtctcgggcagctcgccgaccgggtagaacgccgcgtcgatcgtctcgtcggtctcccgcagcagctcccccgaccagatgtcggcccgcaccgcgagagtgacgtgctggtagggctgcccgtacgcgctgatcgtcagctgctccccggagtacagggcgaacggcgtgatggcgtgcacggtcagcccggtctcctccctgacctcccggatcgcgcactcgccgagcgtctggcgcaactccatggtcccggccggcagtgcccaccgcccattgtcgctgcgccggatcagcagcacccggccgccggggtcgcgcagtacggcacgcgccccgacggtgatcagcacccgctccgggccgaccgacccgcgcagctgcccgaggtaagactcttcccacgccggcatgcggccgaacgtaccttatggcggttttggcccagggaccggcgcggcgccatcgtcatgatggtccatctccgcggcaacgcgggcccggcgtgggcgagcatgagatcgtgcgcacacccggccgggccgcccggcgtcgccgcggcgtcccggcgttgttctccctcggcgcgaccggcctgctggccgccggcggcgtcctgttgctgtccaccctgatcccgccgctgttcggctggtcgtcgtcggtggtgatgagcggctcgatgtgtccggcgattcagccgggcgacgtggtggtgacctcaccgccggcgccgcgggacatccgcgccgggttcgtggtccggttccacgacccgagccggccccggcggccgatcctgcaccggatcctcaccatcgacgagcacggcatgctggtcaccaagggcgacgcgaaccgggtggtggactcggcgccggtgccgcgcagcgcggtgaccgggctgggtcggctacgggtgccgtacgtgggactgccggtgctctggtgggtgcggcgggactatctccggctgatcgtgaccggcctggtcctgctggtgctgtgcgcgctgacgtcggtgggccgcacggcccggcctccgctgcccggccggcgccgagcggggacggcgagggccgccggccgtccgacaacctgaccctgatcggacgaccggccgggacgctcggctcagatctcgtcgatcaggtcggcgaccgagttgacgatccgggacgggcggtacgggtacgtctcgctctccatccggctgctgatcccggtgagcaccaggatcgtctccagcccggcctccaggccgcagaggacgtcggtgtccatccggtcgccgatcatcgcggtggtctcgctgtgcgcgccgatcgcgttcagcgccgaacgcatcatcatcgggttgggcttgccgacgaagtacggcttcaccccggtggcccgggagatcatcgcggccaccgagccggccgccgggagcaggccctcggtggacgggccggtcgcgtccgggttggtgcagatgaaccgggcaccgccgttgatcagccggatcgccttggtgatcgcctcgaagctgtaggtgcgggtctcgccgagcaccacatagtccgggtcgaactcggtcagcacgtaccccgacgcgtgcatcgcggtggtcaggccggcctcaccgatcacgtacgcggtgccgccgggccgctggtcggcgaggaactgcgcggtcgccagcgcggccgtccagatcgactgctcgtccacctcgaagcccatccgggtgagccgggcctgcaggtcgcgcggggtgtagatggagttgttggtgaggatcaggaacggcttgccggaggccttcatccggttcacgaactcgggtgcgccgggcaccggctcaccctcgtggacgagcacaccgtccatgtcggtgagccagctctcgatcgccttgcgttccttcatgcgggggctccaggtcgcggtgcggagggtcgggtcgccggggggcagcactccgtcgggcagacgtcccaggtcggcagcgtaccgagccggttgtggggttgctcacccagccgctcctcgaccagctcgcgcaccatgctgacgaaccgcgggtggacgcccggcgtggcggcccgggcgtagcccagacccagccgctcggcggtctccctggcctcgttgtccaggtcccagagcacctcgaggtggtcggagacgaaaccgatcgggctgaccaccacgtcggtgatccccttctcggcgagggccgtcaggtggtcgttgatgtccggctccagccacggcacctgcggcgggccggaccggctctgccagaccaggtcccacggcacgtcctcggcggcgcgggcctggaccagccgggcggtctcctccagctgggcggtgtagcggccgccggtggggccggcgttgcgggccatgccggtcgggatggagtgggccgtgaaggcgatccgggtgctggcccggcgggccgggtcgagcgtgcccagagcggcacggaccgcctcggcgtgcggctcgacgaagccgggatgatcgtggaactgccgcagcttcatgatcaccggcgctttcggcccgaccgccttgcgggccgcggcgatgtcctcccaatactgcttgcaggacgaatatccgccgtacgcactggtggcgaagccgagggcgcgttcgacaccgtcgtcgcgcatctgggccacggtgtcggccagcatcgggtgccagttgcggttgccccagtacgccggcaggtcgatgccgtgcccggcgaactcggcccgcaccgcggcgagcaggtcgcggcactgctggttgatcggggagaccccgccgaagtgcatgtagtgctcacgcacctcggcgaggcgctcgtccgggacgccccgcccgcgcaccacgttgcgcaggaacggcatcacgtcatcgggcttttcggggccgccgaaggagagcaggacgaacgcgtcgtaaaccacccgccaatcctgccaccgcactaagcggcgatggcgtggtaacccccgtcaacgtgcaccatctcacccgtggtggccgggaaccagtcgctgagcagggcgcagaccgcgcgggcggtcggctccgggttctccagctcccagcccagcggcgcgcgccgggtccaggcatcctcgaagtcactgaagcccgggatcgacttggccgccatggtgcgcagcggcccggccgacacgatgttgctgcggatcccgtgcttgcccaggtacatcgcgaggtaccgggaggcggactcgagcccggccttggccacgcccatccagtcgtagagcgggtaggccttggtcgcgtcgaaggtcatcccgacgatcgagccaccctggtccatcagcggcagacaggcggtcgccagcgacttgtaggagtacgtcgagacgtgcagcgcctgtgccacgtcctcccacggggtctcgaggaaggtgccgccgagggcgctctgcggggcgaagccgatcgagtggacaacgccgtccagcccgtcgacgtgctcgcggacccgggacgccagcgcgtccaggtgctcctggttggtcacgtccagctcgatgaccggagcggtctcggggagccgcttggcgatccgctccaccagcgagagccggccgaagccggtgagcacgacggtggcgccgttctcctgcgcgagcttcgccaccgagaaggcgatcgaggcgtcggtgatgacgccggtgacgagcagccgtttaccggccagcagtccagacaacattctctcctgaaaagaattctcggaaaaactcagtgccccatccccaagcccccgtcgacggggagcacggcgcccgagatgtacgccgcactgtcgctcgccaggaaggtcaccgccgcggcgacctcttccgggctggcgagacgaccggccgggacggccttgatgatctcggccttgcgcgagtcgggcaagacgtcggtcatctcggtctgaatgaagccgggcgccaccacgttcgccgtgatgttccgcgtgctcagctcccgcgtgatgctacgggccatgccgaccaggcccgccttcgacgcggcgtagttcacctggccgggaccgccgtacaggccgaccaccgaggagatgaagatcatccggccccacttggcccgcagcatcttgccactggcccgtttggcgacccggaaggcgccggtcaggttggtgtccaggacccgctcgaactgctcctcggacatccgcagcagcagcgtgtcgtcggtgatcccggcgttggcgaccagcacctcgatcgggccgatctcggcctccacgaagctgaacgcggcgtcgaccgacgcggcgtcggtgatgtcgcactgcacgccgaacaggccctcgggcgcgcccgagccacggtgggtgatcacgacgcggtcgccctgcttggcgaaggcctgggcgatggccagcccgatcccgcggttcccgccggtcaccaacacggtgcgaggcacagcgctactccttaggtagggggtaccacagggtcacgacatggcccgcacagcgccttaccctgctggggatggagactactggcccgaggcggcgaaacggggcaatggggccgctggtccggctcgcggtcggccgcgagaccgcccgtccgccggtccgcgggcgcctccggttcaccctcccgctgatcctgttcgtgctggtcagtctgggtctggcggcgtgggaggagctcagcacgacccgggagatcccggccctgctggtcgggatcatcgcggtgggatcggtgttgccggtcgcggtgtcgtaccggtggccggtgaacgcctggcggctcaccttcctgatgatcttcctgggctgggtcgaccacgcgcccggcgacccctggccgtggaacgccgtgcagatcctggccacgctgttcgtgctgggccggctcgccgcggtcagcgcctccccggtcacgctcggggccaccaccctcaccgtgatcgcggtgctgctgctcggcggggcgaactccgggggcgccgcggtgctgatcgtggcgatcaccgcgctcgggaacatcgcctcgcaccgccgccgcacccgcgagctgctcgccgagcagaccgagctgaatgagcaggaacgcgcgaaacgggcggtgctggaggagcgcacccggatcgcccgggagatgcacgacgtggtggcgcaccacatgtcgatgatcgcggtacaggccgagaccgccccctaccggctgccggctctgcccgacgaggcccgcgacgagctggcgtcgatcgccggagcggcccgcgaggccctcgcggacatgcgacggctgctcggcgtgctgcgtgccgagcaccaggaggcggaccgggcgccgcagccggggtacgccgagatcgccgccctggtgatcaccgcgcgccgggccgggctgccggtcaccggcgagctgggcgaggtggccggggtgggcgaggcggccgggctggcggcgtaccggatagctcaggaagcgctggcgaacgcggcccggcacgcgccgggcggcccggtgcggctgaccgcccgcgccgccggcgacgacctggagctgtcggtcaccaacgagctgaccacgccgccggaaccgggacaccggccgggacacggattgatcgggatgcgtgagagggtggctctgctcggcggcgagctgtccgccgggccggacggcgccggggcgtaccgggtgctggcccgcatcccccggcagccggagacccgatgatcaaggtactgatcgccgacgaccaggcgatggtgcgccagggtttcggcgcgctgctggccgcccagccggacgtgctggtggtcggggacgcggcggacggcgcggccgcggtcaccgccgcccgcgagctgaatccggacgtggtcctgatggacatccggatgccggtgatggacggcctggaagccacccggcggctggccggcggcccgcggatcctgatcctgaccaccttcgacctcgacgactacgtgtacgaggcgctgcgcgccggcgcgagcggcttccttctcaaggacgcccccgccgccgacctggtgcaggcggtccgcgtggtggccgccggtgaggcgctgctggccccgtcggtgacccgccggctgatcgccgacttcgccgcccgcccgcgcgccgaccggccccgcccggtcgcgctgaacgcgctcaccccgcgcgagaccgaggtgctgcggttgatcgcccgcggccggtcgaaccaggagatcgccgccgacctggtggtggccgagcagacggtcaagacgcatgtcgggcggatcctgatgaaactcgcgctccgcgaccgggcgcaggcggtggtcttcgcctacgagaccggcctggtcgcggccggggagtgacccgtccgggtgttcctcgacacctgatttttcttaagtggcgcttaaggggtacagtccacgacggttcccaggcccgacgaccgacggaggtgatcgctgtgcgagatagcgatcctcctagtcgtggccgggacgctcgtcagcgcttctgaccgctgaccagatctcccacccactccaccggacgcaccctgaccccagggtggccggtcgtgtcgtgtgcgccgcgacaccaccgggagtgggcatggccgcgacgtgaccgcgtgttctctccccgcccgtcacgctgcggaagtaggtggccccaccatgaagaacctgatcgctcccctcggcttcaccgtgatgaccgcctgggtcgtcctgctcttcgtcctgacctcgcacaacgcctgaccggctcggccggctcgcacggcttcacggcagccgcgacgtccacagcagactcgtcgcggcgccgatcagcgccagcagcagggccgtcgcggcgtaccactgggttacctcgcgcggctgcgtccggtgcccgatcgagctgcccatgtcctggtagaccttcttgagctcgctcaccgaggccgcctcgtagaagtagcccttggtccggtcggccagctcctgcagcgagagccggtccaccggcacccgctgcagctggccgcggatgtcgaccacgccggtgtcggtgccgaaggcgatcgtgctgaccggcacgttcgccccggcggccgcggtcgcggcgtcctcgatcgagcggccggaggtgcggtacccgtcggagagcagcacgatccgggccggcggcgcgccgttcgccccgtccccgggcaccgagcggatcgcgtccagtgaggtgaacaccgcctccccggtcgcggtcgcctcggccagggtcagcgagtcgatcccggccagcacctcggaccggtccttggtcggcgcgaccagcacgttcgccgccttcgcgaaggacaccaggcccaggttgtaggtgggcggcagctcgttgacgaacgccttggccgcctcctgcgccgcctggatccgggtcggggccacgtcgtcggcctgcatcgacagcgacacgtcgatggccagcatcacggtcgcccgctccagcggctgcttggtgtccaccgacggccgcgccgtggagcacgccagcgccgccatcatcagcaggaacgcgaccgccgacacgtgccggcgccagcccagccccttcggtgcgagggtgcgcagcaggtcgacgttggtgaagcggatcgcgaacgacttgcggcgcagctgccgccacacgtaggcgccggcgacggccaggacgggcagcagcgtcagcagccaccacggagccaggaaacggatcatcgagtggtcccccgggtgcgtgcgtgtcgttgggcggccacgaagcggaccatgtccagcagccagtcggtgtcggtgcgcaggcgcaggtgggcggcgccggccgcgcgcagggtgcgggcgatcgcggcgcgctgctcgccggccgccgccgcgtaccgctcccgcagtctcggatcggcggtctgcacctcgtgcagcgcgccggtctccgggtccatcagggccagcacgccgacgtccggcagctccagctcccgcgggtcgaccacctcgatggccagcacgtcgtgccggacgccgagccggcgcaccgggcgggcccagccgtccaccggggccaggaagtcggagatcaccacggccacaccgcgccgccggggtggccggttcagcgtgtcgatcagggcgcccaggtcggtgcgcccgggccggatcgcggtgcgggcgatcccgcgcagcagcccctgcgcctccttgcggcccggccgggccggcatccgcaccacgtcgccgccggtgccggtgccggtgccgaccacggcgcccacccggttgccgccccgggcgctcaggtgcgtgatcgcggtggccgcggcgatcaccaggtccttcttcagccacttggcggtgccgaagtcgaggctggccgacaggtcgatcgccatccacgtctccagctcccggtcggccaccgtgcggcgcacgtgcgggagcgtggtgcgggcggtgaccggccagtccatccggcgcacatcgtcgccgggacggtactcccgggactcgccggcctcggtgcccggaccgggcagcaggccgacgtagtcgccctggagcaggccgtcgagtttccgggtgaccagcagctgcaggcgggcgagcacggcctcggctcgggccgcctcctcgggcggcgccggtggcggcgtggcgggcaggctcacgggtgcggccagccgccacctagctagctaggcacggcctgcatgatccgcgccacgatctggtcggccgggacgtcgtcggcgagcgcgtcgtagctgagcaccaggcggtggcgcaggatgtccggcgcgacgtcctgcaggtcctgcggcagcgcgtagtcccggccgcggagcagggccagcgcccgggtggcgcggacgatgccgagcgaggcgcgcggcgaggcgccgtactggatcagttgggcgacgtcgggcatgccgtgctgggccggggcgcgagtggccagcaccagccggaccgtgtagtcgaccagcgcgttgtgcacgaacacctggtcggcgcggcgctgcagggcgagcaggtcgtccggggtgaagacctgcttgggctccggcgcgctgacccccatccggtagacgatctcgcgctcctcggcatcggtcgggtagcccacgatgatcttcatgaggaagcggtcgcgctgcgcctcgggcagcgggtagacaccctcctgctcgatcgggttctgggtggccatcaccaggaacgggtcgggcacctcgtggctcttgccgccgatcgacacctggtgctcggccatcacctcgagcagcgccgactgcaccttggccggggcccggttgatctcgtcggccagcaggaagttgacgaagaccgggccgagttcgacgtcgaacttctcgttgctctgccggtagatccgggtgccgacgatgtcggccgggaccaggtcgggggtgaactgcacccgggagaaggtgccgccgaccaccttggccagggtctccaccgcgagggtcttggccaccccgggcacgccctccaacaggcagtgaccgcgggccagcagcgccacgaacatccgctcgaccatccggtcctggccgacgatgacccgcttgacctcgaacatcgcccgctccagctgcgacgcgtcgtgcgccggcggaaccggggcggccccctccggggtggtctcggtctcgggcgtgctgggctgcgccaccggtcctccacaacggtcacctgtccgccggcgcggatgccgacggtcaagacttacacgacgttcctggaagcatagagaccactccccgccatcccggggatccgcgcagcccagggcactatcggccgaacatgttgatctttctgcgcgatccgccggaacgggcacgctcaccgggtggatacggaagtctgtgaaccgtgtagcatttacctcgtcgccgggcggcttcccccgtggccgcccggcgcataacactcttttatttctcccgagtcgtttcccttatgttggtcgacatggttgaggaactctccccgcagtgctccgccaaaggttgccgtgcgtcggcggcctggcaactactctggaacaatcccaagctgcacgcaccggaataccgcaagacctggttggcctgcgacgagcaccgggtctccctcggcgcgttcctcgaagcccgctcgttcctgcgggaagtgacggctttcgagtcgtctcctacgctctagggtgtgagcacgccgccgatcgatgccctgcagccctggccggacacggtccagtggcgcccggtctcccgcaaactgatcactgtggaactgctcgggctcgccgtctggcagacggtcctggtgctcggcctcggcatcgcctggctgttcctgcgccagtggggctggctggccggcatcggcggggtgctgctgatcggcgtctggcgggccgtcgtcgcgatccgcgcggtccgcgcctggggatacgccgagcgggacaacgacctgatggtccggcacggactgctggtccgcacgctgtccatcgtcccgtacgcccggatgcagtacgtcgacgtcaccgccggcccgatcgagcgcgccttcggcctggccaccgtgcagctgcacaccgccgcggcggccagcgacgcccgggtgcccggcctgccgcacgaggaggcggcccggttgcgcgaccggctcaccaccctcggcgaggaccgggccgagggcctgtgaccgccaccgggaccaccacggagcaggccggggtgcgacgccggctgcacccgctcagcccgctgctgcacggcgccaagaccctcgccgtgatgatcgcggcactctcctggcagaccctgcgccagctcgggctggcccacttcgcgctggtcgtgctcgccatcgcggtcggcgcggtgatcttctcagcggtcggctggtggaacaccggctatcaggtggtcgcccgcgagctgcggatcagcgacgggctgctgtggcgccggcaccgggccatcccgctcgaccgcctgcagtcggtggagctgcgccgcccgctgctggcccagctcaccggcctggccgagctgcgcctggaggtggtcggcgggaacaaggcggaggccccgctggcctacctgagcgtgcgggaggccgcggcgctgcgcgagcgactgctgtccctctccgggtcggctcccctcccgctgcccgcggtcccccaggagaatctccttctggcggtacgcaaccggcagctgctgttcagtcagctgctcaccccgcaggccttcctgctgccgatcggcgtcgcctgggtgatcacccagttcgtgatggaggggtcgtggaccttcatcgggatcgccagcaccgtcaccgcgatggccggggtgctgctccagccgatccgtcgggtgctgcgcgactgggatttccggctggcccgcgacgccggcggccggctgctgctgcgctacggcctgaccgagacccgcagccaggtggtgccgctgcaccgggtgcaggcggtccgggtcacctggccgttcctgtggcggctgaccggctggctgcacctgcagctcgacgtcgccggttatcacaacccggagcacggccgggacagcggctcggaccggctgctcccggtcggtgacccggccgccgcccggctgctgattggcgccgtgctgcccggcgtcgacctggccaccctggccacctccccgccgccgccgcgggtccgctggctgcacccgttcgagctgcgcttcatgggcgtcggcctgcaccccgacgtgctggtcacccgcggcggccgggtgtcccgggagatgacggtggtgccgtacgcccggctgcagagcgtccgggtcgagcagggtccgctgcagcgcctgctgcgggtcgccacggtgtacgcggacgcggccggcggacgctccggcgtggcccgcgaccgtgacctggccgaggcgtgggcgctcgccgacgagctggcccgccgggcccgcctagctagctagcccgccccggcgccggccggcggtcagccggccgacgactccccctggcaacgcccggcaccggcctaagctgtcggcatggagctcccggagttcgctcccggcctcagcgcccgggtcgagttgaccgtcaccgatgccgacaccgcccagtccctcgggtccggtgacgtcccggtgctggccacgccccgggttctggcgctggccgaggccgccacggtcgccgccaccgcccgccacctgcccggcggcatcaccaccgtcggcgtccgtgccgcgatcgaccaccacgctccggccgccgtcggccggacggtgaccgcccaggccgcactgacccgggtggacgggcgcacgctggccttcgacgtgacggtgcgcgacggcgccaccgtgatcgccgaggtccggatcgaccgcgcgatcgtcgaccggcagcgcttcatcgccaaggcgctcggcgactgagccggtccggcggggtcgggctcaaagctcgccccagcgggcggtcacctcggccggggtcggcatcgcggtggcgccgcccgggcgttcgcagaccagcgcggccaccgcgagcgcgaaacgcacctgccgccgccagccggccgcatccgccgggcggccctcggccagcagccggctgaccagcgcacccatcaccgagtccccggcgccggtggcgtcgaccgcggccaccaccggggccggcaccagcaccgcgtcaccggccgcggcgatgtgcgcgccgcgggccccgcaggtgaccacgaccgcgccggcacccagcgcccggatccgccgcgccgcggcggccacatcggcgtcgccgtagagcagctcgacgtcggccgagctgagtttcaccaggtcggccgtggcgaagaactcctcgaccaggtcgcgcagggcggtcacggcggccgcgtcgggcagcagcttcgggcgtacgttgggatcgaagacccgcaatccggtgaagtccgcccacgcccgccgggcggccgtccggaacggctcgcggagcaggcagatcgacccggtgtagagcaggtccccgccggccagcgtggccgggtccagatcgtccgcggtgagcagggcgtacgacggcggctcgccgtagaaggtgaacgccggctcggcgccctggaaggtggtcaccgcgagcgtggtcggcaccgcgacccggcgcaccccggcggcaccgacgccggcctcggccaggaaggcggcgatccggtcgccgagtacgtccgtgccgagcgtgccggcgtactccacccggccgccgagtcgggccaccgccaccgccacgttgagcggcgcgccaccgatcgcctgccgatagatcaactcgccgccgcgctcagcctccagcagatcgatcagcgcttcgcccagcaccaccgcgtaccccatgccgtgtcctctccgccttcgatgccgaaagcctcgcgcgagcgcgcggggaaatccagcctgaggttctgtcaccggataaatccgcttttgagacaattgcgggatgttccgcatcttgcccaccgtcctggccggcctcagcatggggatggccgtcccggctcccgggccggccgtcttcctgccctggaaagccggccgccaggcgatcacctacgatgccgcgctggtcccgccgggcgccaccgccctggtcgagttcagctccaccgggcagaacctgtggatccgtctggaggtcaccggcctggtgccgggccacacctacggcgcgcacatgcacgtcgccggctgtgggaagaatccgtcggcggccggcccacacttccagcaccaccacgctccggccgcggccggcgacggcgatccgcggtacgccaacccgtcgaacgagatctggctggacttcaccgccgacgcgcacggcggcgcggtggtccgtcgcgagcagcactggatgttcgcccacgagcagccgccccgctcgctgatcctgcacgccgagccgacccggaccgggccgggcacggccggcaccgccggggcccgggtcggttgcctgaacctgccgttcggcaacggcaccggtgggcggtaacgtcggcctaccgctagtgaacggaggcaccccacgatggcgcagcaggacggcggcacacagcccgcccccaagacggagtcccacgacccggccttcccggaggcgttcctggcgttcatgcgcaccggttggcgcgaggacccgatcgcggtcgccccgctgcccgaggtgccgaactacgccaagcgccgtgccgcgctctccgaggcgttccccggcgagacgctgatcatcccgagcggcaacgagaaggtgcgcgccaacgacaccgactacccgttccgcccgggcagcgacttcttctacctgaccggcgaccgtgatccggacagcgtgctgatcctgcacccgaccgcgtccggccacgaggcggtgctgttcacccgggagcgcaactccaaggagagcgaccgcttcttccgcgaccgcaacggcgagctgtggatcggccgcacccacacgctcgccgagaaatcgaccgagctgggcctggagaccgcctcgctgggccacctgggctcggcgctggcccagtccgccccgggccgcacccgggtgctgcgcggcctcgacccgaacgtcgaccggaccgtgctggcctacgagcccgaccgggccaaaccccgcgaccgcgagctggcctgggtgctctccgagctgaagctggtcaaggacgagtgggagatcgcccagttgcaggccgcgatcgacgccacggtgctcggcttcgaggacgtggcccgggtcctgccggccgaccgcggggtcaaggagcggctgctggagggcgtcttcgggctgcgcgcccgacacgacggcaacgacctgggctacggctcgatcgtcggcgccggcgcgcacgcgacgatcctgcactgggtccgcaacaccggcgtgaccacgccgggcgagctgctgctgatggacatgggcgtggagggccacaacttctacaccgccgacgtgacccgcacggtcccggtctccggcacgttcacccccctgcagcgccaggtgtacgacatcgtccacgcctcgcagcaggccgggatggacgcgatccgtcccggtgtgctgttcaaggacgtgcaccaggcgtgcatgcgggtgctcgccgagggtctgcacgacctggacctgctcccggtcagcgtcgacgaggcgatggccgaggacagcaccgtctaccgtcggtggaccctgcacggcttcggccacatgctcggcatcgacgtgcacgactgcgcgaacgcgcggaacgagacgtaccgggacggtccgctcgccgagggctacgtgctgaccgtcgagcccgggctgtacttccagcccgaggacgagctggtcccggccgagctgcgcggcgtcggcatccggatcgaggacgacgtggtggtcaccgcggacggctgccgcaacctgtcggacggcctgccccgtacctctgccgaggtcgagtcgtggctggcggcacagcgcgaggccggcccgcgcctgcccggctgaggactccgctcaccggtgcgacgcgtcgcaccggtgagctacccgatccggtagtcgctgacgctccagcactcggccccgtccgcggcgccggtcgtgttcagggtgacccggaccgggtggccgtccttgacgtcgaactcggtggtcacctgaccaccgtcgtccgcggtggtccgcgccatctccagcagcccggccagggtcggcacgtcgatctcctcaccctgctcgccggtgaccgggcccagatcgacgtcggccgacgggttcggcgcatccggcgtcccgatccgggtcgcgccggccacctgcccggcgcgcaccttcgcccggtaacgcccggccggcttggccgcgtcgcagccccgggtcagcacataggaatacgcgtccggctcagtccagggcggcgccgaggcggccaccgacggctgggtgaacttcggctcgtcgggggcggtggaggtgcagccggccaccagcccggtcagggcaaccgcgcacaggacccgctggaaccgcaccgcaacctccactctgccgccccacggacggcatgcggcgcaatgtagcaccagccttcatcgacctccggctctccgggcgcacccgacgaaggaccgccgcgccgcacctgatcccgatgggcagaacctcgaccccgtccccgcatccgagcgaggccggagccgcgcggaggcgcccgtgccgggactcgttgccgccgggtgtcagcgggaagcgatcaccgtggtgatcagcgggccgtcggccccgatccggaccaggtaccggtaccgctcgccggggaccgccccaccctcactgtccaggtactcccactccacctcgaccatggcgagcgccgccgagatccgctgcaccccgaggatctgcgcatgcgccgcgacgatccgctgttcccgataggtgggcgcggcgcccaggaaggagagcgcgacggcggccggcgagctgaacgtgaagctgtacgagtcggccaccaccatcccgggcagggcgtgacagcctgcgatgccgaccacgtcgccgatggtgagcgccgcgccgtagcggccgaagaagtcggtgagctgatccagatccgcctgggtcgtcatggcgtggcgcgttcccgggaatcgacggaaccaaacgtggacggctggaaggatcagcacgtggaccccgccttgcgatggctagcaagacggacgtacggtttaccggacacgcacaaccgagagttaggcaaacctaacccgaaggtcgccctttcggtgcgaaagacttgacttccagtcgctgggtgtgaaggagatgacggtggccagcctcgacacctttggtgcgaagagcgagctgcgcgtcggagacgcgagctacgagattttcgagatcgacaaggtggagggccacgaccggctgccctactccttgaagatcctcctggagaacctgctccgcacggaggacggcgcgaacatcaccgccgaccacatccgcgcgctcggcaactgggaccagaacgccgaccccagcgtcgagatccagttcaccccggcacgggtgctgatgcaggacttcaccggcgtcccctgcgtggtcgacctggccaccatgcgggaggccgtcaaggacctgggcggcgacgccaccaaggtcaaccccctcgccccggccgagctggtcatcgaccactcggtgatcgccgacctgttcggccgtgcggacgccttccagcgcaacgtcgagctggagtaccagcgcaaccgcgagcgctaccagttcctgcgctggggccagaccgcgttcaacgagttcaaggtcgtcccgccgggcaccggcatcgtgcaccaggtcaacatcgagtacctggcgcgcacgatcatggagcgcaacggccaggcgtacccggacaccgtggtgggcaccgactcgcacaccaccatggtcaacggcctgggggtgctgggctggggcgtcggcggcatcgaggccgaggccgcgatgctcggccagccggtcagcatgctgatcccgcgcgtggtcggcttcaagctgtccggcgaggcgccggccggcaccacggccaccgacctggtgctgaccatcaccgagatgctgcgcaagcacggcgtggtcagcaagttcgtcgagttctacggccccggcgtgagcgccgtgccgctggcgaaccgggccaccatcggcaacatgtcgccggagtacggctcgaccgtcgcgatcttcccgatcgactcgcagaccatcgactacctcaagctgaccggccgcaccgagcagcaggtcgccctggtcgaggcgtacgccaagcggcagggcctgtggctcgacccgaacgccgagccggactactcggagaagctcgagctcgacctctccacgatcgtcccgtcgctcgccggcccgaagcggccgcaggaccgggtgctgctcagcgcggccaagtcggcgttccgcgacgcgctgccgaactacgccgcgccgcacggccacgccgacgaggccagcgaggagtccttcccggcctccgacgcgccggccaacggcgtcgacgacgaggccgacaagccgcacctgttcagtgccgcgctcggcgccaccggccgcacctccaagcccacccgggtcaagggcgacgacggcgtggagtacgagctggaccacggcgccgtcgtgatcgccgccatcacctcctgcaccaacacctcgaacccgcaggtgatgatcggcgccgcgctgctcgccaagaaggcggtcgagaagggcctgacccgcaagccgtgggtcaagaccaccctcgcccccggctccaaggtcgtctccgactactacgaccgggccggcctcacgccgtacctggacaagatcggtttcaacctggtcggctacggctgcaccacctgcatcggcaactccggtccgctgcccgaggagatctcggccgcgatcaacgaggccgacctcaccgcggtctcggtgctctccggcaaccggaacttcgagggccggatcaacccggacgtcaagatgaactacctggcgtccccgccgctggtcgtcgcgtacgcgctggccggttcgatggacatcgacatcaccaccgagccgctcggcaccgggtcggacggcaagccggtctacctgaacgacatctggccgtccgcgcaggagatcgacgaggtgatcgcccaggcgatcggcgccgagggtttctccgccgcctaccaggacgtcttcgccggcgaccagcagtggcagtcactgcccaccccgaccggtgacacgttcgcctgggccggagactccacgtacgtccgcaagcccccgtacttcgagggcatggccgccgagccggcgcccgtcgccgacatctcgggcgcacgggtcctggccaagctgggcgactcggtcaccaccgaccacatctccccggcgtcctcgatcaaggcggactccccggccggtaggtacctcaccgagcacggcgtcccgcgcgccgagttcaacagctacggctcccgccgcggcaaccacgaggtcatgatccgcggcacgttcgccaacatccgcctccgcaaccagctggttcccggcgtcgagggcggcttcacggtcaaccacctgaccggcgagcagaccaccatctacgacgcctcggtcgcctacaaggaggccggcgtcccgctggtcatcctggccggcaaggagtacggttccggctcctcccgcgactgggccgccaagggcaccatgctcctcggcgtccgcgccgtcatcgccgagagctacgagcgcatccaccgctccaacctgatcggcatgggcgtcctgccgctgcagttcccgcagggccagaacgccgagtcgctcggcctgaccggcaccgagacgttctccttcgagggcgtcaccggcctcaacgacggcaccacgccgcgcaccgtcaaggtcaccaccgacacgggcatcacgttcgacgcggtcgtccggatcgacacgcccggcgaggcggactactaccgcaacggcggcatcctgcagtacgtgctgcgcaagatgctgcgcggctgaagatctgctgaaccggcgggtcgctcctcgacccactgatgcggcggcgccccgctctccccagggagggcggggcgctctccctttccggcgttccccgggcaacctcggctagagcgctccgagctcggcgtggaccgttccggtacgcgggcatttccagaccgggacgtcgtccgcgatcccgaccgtcagcgggtgggtggcgggatgttccgggcattccggccagactgccgggagtcccagttccggtaggcattccagaagccagtcgtgcagctgatcggccgccgtggccacccgctggtacaggggatccgccggatgcggcacatgaccgacgagccccgaagcgcccgccacccgcagccagaactccggctgcccggaagctgccgccccgccgctcccccgccctgtcgtctccgccacggtgacccgcatcggcgaggcgacacgcagatcacggagaatcggccggagctccaccggctcgtcatcgttcaccaccccaccgtaacgacgcgccgtcgaacatccgggcccacccgggagtccgcggtcaaccgcccggttgcagcgcccggtccactcccgagatctcgtcccgcggcgatcccggccgccccggcgcccgcaaccccggccctgcgccggccacgagacaaccccgggccacctccctttgccgggcacctcgacacgggcagggagcgaacggacggtgggcaagggcggcgtcgatcacggtctgcgacggcgaacacgcgtggcccggcgccaccgtcggcactccggtgaataggcttcgggtatgacggatgacaacagcgtgctgaaccgcattcacggcctggtcgaggaggagcaccagctccgcagcgagctgggccagggcaagatttcctcgaccgaggagcacgcccgcctcaaggagctggaagaggctctcgaccagtgctgggacctgctgcgccggcgccgggccgcccgggagaccggcaacgacccggaggcggagaaggcgcacagcgtcagcgaggtggagagctacctgcagtgacccgaccgcggtcgccgacctgttgcggcgaccgcgaacgggttccggtcagcgatgccgcggagggaggccggtctgatgcggcgatcgcgaaccgggatcaggtcaccggcgccgtgggtgggacccgggtgggcgcgatgccgggcggcggcagccgagcagcggcgaggcgccggtggggcagcaccggcggcggccgggccggggcagccgcctcactgcaggcccgcctcgaacagcaggcgggcggtcagcgcttccggatcgaccgggagtccccgcgaacggaaccagccggcgacgttggtgacgtcccgggcgatgaactcggcaccgcgcggattcgcgaccacgtcgacgatctggggcaggtcgatcaggaccagacggccgtcgcggaccagggtgttgtacggcgacaggtcgccgtgggccacctgggcgcgggccagcaccgacagtgcgtcggtcatctgctgccacagactttccaggtcgccgtccccggagcggagctgggccagccgcggggcggcctcgccggtctcccagtcgccgatgaattccagcatcacctcggtgccggacagctgcaccgggtacggcacacagaccaggccgctctcctgcccgatctgccacagccggccgagcgcgtcgaactcggcggccgcccactgaccggcgatcatctccttgccgaacgcggtccggttcgtcatcgcccgcatctcccgggaacgacgcacccggcggccttcgagatagccggcatcccgatggaacatccggtgctcgccgtcccggtaccgtttggcggccagcatgctggtctccccggtcgccggcagccaccgccggaccaggaagacatccgcttccttaccggttttcagcacacccagctcggtgtcgaccgcgccgtgctcggtgcgcacccagtcaggccggggctgcggaccgtgcagagcaccgtcccagctggaccagttgtcaccgacctcgggcaggtcgggatcctctttgagggccggctccagccggccggatttcacaaagcttgcttcgtcatcatcgaacttgcggcggccacggcgcatcgtcgtcggaccgtaggtgtcgtgctcgcgcactggagggtctcctcagcgaaagaagttttccgggaagccgggacagcaggcatcacaaagacagccatttcttggccacccccttctctctcgctccgaccctcacagccggaatccgcaacggcacccacaccgccacgcgccgccgactctccccgaccccaccgccacccgcaacccatttaccgccgcccgtccacagcccagcccagccccgccccgagacaacggcgggagcaggcccccgacaggacaggacgacaggctcgaccggcacgaccgccggcccgccgcctcaggacacgccgccaccgaacccgcgacacgggccaggccgcgcggggtcggggcagcgcggcggcgacggaaagcgcggcgggcgggcgccggaaggcgcggcgggcggagggcgccggcgaaccgagggcgggcggagggggcgggggcatgggtcgggcgacggcggtcgtcgacagatgtataaacctatttaacctatgggcgatatggtttgacggagctgaggagactatcgatggatttgcaactcgccggtaagcgggcactggtgaccgggggcagccgggggatcgggctgcgcatcgcgcggtcgctgctcgccgagggagccgatgtggcgatcgtcgcacgtgacggggaacggctggccaaggccgccgccgaactggcggcggcgggccatcccgggcggatcgtcacggtgcggctcgacaccggtgacgacgcgtcggtgcgggccggtgtgcagcgggttcgcgagcagctcgggggcatcgacattctggtcaacaacgcggcggtgcccggcggcgggccgggtggcccgatcacgccgtcgcagaccaccgaccggcagttcgtcgacgcggtcaatgtcaaggtgctgggatatctgcgcaccgcccgcgccgtggcgcccgacctgatcgcccagggctggggccggatcatcaacatctccggcctggccgcccggctcagcggcgacttcgtcgcgaccgcccgcaacatcggtgtggccgcgctcaccaagaacctcgccgacgaactcggccggcacggtgtcaacgtcacggtcgtgcaccccggcgccaccgtcaccgagcgcacgcccgcgctgatcgcggcggccgccgagcagtggggcgtcaccgtcgacgaggccgaacggcgccgggccgagcggaccgcgatcggccgcgaggtgaccgccgaggaggtggccgacgtggtgaccttcctcgcttcgccgcgcagcgtggccatcaccggcgacgccgtcacggtcggcggtggcctcatcggcccgatccactactgaaccggcaccaccctgatcaggagcgcgtcgccatgatcgccgagattccctggatgacgttgcccaccgtgcgggtcggagcgaagcgtgtgtccatccattcgcgcccccgatgcagccacacgctgggcagcccgagagccgcggcgccgccgatgtcggcttccgggctgtcgccgaggacccatgcgccggcgaggcgcatgcggacgcgctgggcggcgagggcgaagatccgcgggttgggtttgctcaccccggcctgctcagaaatcacccaatcggcgacatagcggtcgaggccggtgcggcggatgcggccttcgcactggtcggtggtcccgttggtgacgacgaccgggacgaggccggcgtcggcggcgatctccagggcgcagccgaccatcgggtcgaggcgttcgtaggtgagcgggccttcgtggagttcgtcgacgaggtcgatggcggggacccggagctggtagcggtcgaggatctggtcggcgaggtcccaccgggaggtgaggccgtccgcgtccacggcgaccagccagtcaagatcgtcttgcgaggcgccgatctcgtcgaggaagcctttcgcccacagccggaacgcaccgctgcggtcgagcagggtgtcgtccagggcgaggaagactagaggcacccgcgcaccttacgtgagcgacgaccgcagcgaacagtccaggactgtaaacaaagcgcctaacgcttgacgttattcgcatcatccgatcgtggtttaggaagccgtacgtacggattgcaagagtgcgggccaccatgacacgatcagcggcgtgcccagggtaagccaggaccagctcgacgcccgccgccacgagatcctcacggcggcgcgcggctgtttcgcgcggttcggctacgagggggccaccgtccgccgcctggaggaggcgacgggcatgtcccgcggcgcgattttccaccattttcgtgacaaggagtcgctgttcctggcggttgccgaggatgacgcggtcaccatggccgagaccgtcacccgcaacggtctcgtccaggtgatgcgcgacctgctcgaccgggccggcaccagcgacggcgacacggccggctggctcggcacccagctggaggtgtcccaccggctgcgcaccgacccggcgttcgccacaaggtgggcgcagcgggcggccgcgatcgccgacgccacccacgagcggttgcagcgccagcgggaggccggggtgctgcgccaggacgtgccggtcgaggtgctcacccagttcctggagctggcctatgacggcctcgtcctccacctggccaccggccgcccgccgggcgacctggcgcgggtgctggacctggtggaggacgccgtccgccggcactaagccgggaccttgtccaggaatccgaacacctgcgcgatccgcccggagccgtccagcaccgccacgtcgaagccgatgaccagcggctcctgtcccggctgccccaggtgccaggtgaaccggccctgctcgtggtgcgcgtccaccgccccgccgaggctgaacacgagccccgggaactgctggtgcaccgccccgatcagcccgctcagctcgtcctgcccgcggaccgccgcgatcgggtccacatagctgacgtcctcggcgaagacgtccgtgatcgcggcccggcgggcgtcggcgtcggtctcgttccagatcgccaggtaccgctcgaccatggtgtcgaagtcactcatcgtcgtttccctccgtcgtggtgtctgacgggactcagcctgccgccgtccggtaatcccggcgattacctccggggtaatgccccctccgcagtccgccgcataacctgaccaccatgagcgcggtcgggcagttgttgcggacgtggcgggacgagcgccgcctgagtcaactcgacctgtccggccgggccggtgtctccgcccgccacctgtccttcgtggagaccgggcgctcccggccgacccgggagatgatcctgcgtctggcggaggagctcgacgtaccgctgcgccatcgcaacgagttgctgctggccggcggtttcgcgccggccttcaccgagtcggacctggacggcccgccgctggcggtggtcctcgacgggctgcggcaggtgctggccgggcacgggccgtgcccggcggtgctggtcgatcgacactggacgatggtcgacgcgaacgccgcgatcgaccgcttcacccgcgactgcgcccccgagctgctggagccgccggtgaacgtgctgcgtctggcgctgcacccggacggtctggcgccgaggatcgagaatctcgccgaatggcggacgcatctgctgcaccgcctggaccggcaggccgccgcgaccggtgatccggtgctgcgcgggctgcgtgccgaactggccggctatccgggtggcgagctgaccggcgagccggtcggcgtggtggtcccgttgcggtatgccgggctgaacttcttcagcatcaccgcggtgctcggcacgccccgcgacgtgaccctgtcggagctggccatcgaggcgttcctgccggcggacgccgcgaccgcgaccgcgctgcgtgaataggcgagaatggggcgcatggatctcgggctggctggtcgcgtcttcattctcaccggcgcctcgcgggggctgggtttcgccaccgcgcaggcgctggtcgccgacggcgcccgggtggtgatctcctcgcgggacgagcggaatgtcgcggacgcggtcgccgggctcggcgggccggagcacgccgtcggggtgaccgccgacctggccgatccgggcacgcctcgcgagctggtcgatgtgacctcggagcgatacggccggctggacggcgcgctgatctcggtgggcggtccgatgcgcggcaccgccgccgggctgaccgacgagcagtggacggccgggttcgagacggtgttcctgggttcggtgcgggccgcccgcacgttcgcggcggcgctgcccgagggcggcgcgatcggcctggtgctgtccacctcggtgaagtcgccgctgaccggtctgggtctgtcgaacgggctgcggccgggcctggcgatggtggccaaggacatggccgacgagttcgccccgcgcggggtgcgggtgctgagcctgctgccgggccggatcatgaccgaccgcaaccgggagttgttccaggccaccggcgatgcggcgaccgcggcggcggaggcggccgcgtcggtgccgctgggccggctgggcgagcccgccgagttcggccgggtggccgcgttcctgctctccccggcggcgagctacctcaccgggatcgcggtgccggtcgacgggggtgcgctgcggacactgtgagcgacgtgctcggtcccggcctgcgggtgctgttctccggcatcaaccccagcctgtattcggccgagaccggtcaccatttcgcccgccccggcaaccgtttctggccgacgttgcacggcgccggtttcaccgaccggctcctgcacccgtcggagcagcatctgctgcccgcgctgggcctgggcatcaccaacgtcgtcgcgcggcctacggcccgcgcggacgagctgtcccgcgacgaactgaccgccggtggtcaggttctcaccgatctggtacgccgtgagcacccgagtttcctcgccgtgctgggggtgacggcgtatcgtgccgccttcgcccgcccccgcgcacggatcggccgccagccggacctgctcggcggcgtcccggtctgggtcctgccgaacccgagcggcctgaacgcccacttccagctccccgacctgatccgcgagttcaccgccctgcgcgaagccgccttctagggttcgaccgtgccggccgggacggtgacgatctcgatgtcctcctccgggtaggtggccgaggcccccgcgaactgggtgcggtacaggtcggcgtagaggccgcccgcgttcaccaactgttcgtgggtgccgcgttcgacgacccgcccctggtcgaggacgacgatcaggtcggcttcccggatcgtggagagccggtgggcgatgaccagcgcggtccgccccctcaaggcggtggacagggcccgctgcacggccgcctcggactcgctgtcgagatgggcggtggcctcgtcgaggatcacgatcgacggctgtttgagcagcagccgggcgatcgcgatgcgctgcttctcgccgccggagaagcggtagccgcgctcccccaccaccgtgtccagaccgtcgggcaggccgcggaccaggtcaccgacctgcgccccggccagggccgcccacatctgctcctcggtggcgtccggccgggcgtaccgcagattctcggcgatcgtctcgtggaacaggtgcgagtcctgggtgaccaccccgaccgtgtcgcgcagcgagtcgagggtggcgtcgcggacgtcgacgtcgccgaccaggacggcaccgccggtcacgtcgtacacccgggacaccagcatggaggtggtggatttgccggcgccggacggaccgaccagggcgaccaactgtccgggttcgacggtgaagtcgacgccgtgcagcaccggggtgttctcggtgcggtccagggtggccacgtcctccagggtggccagggacacctcggccgcgctggggtagcggaaccggacgtcgcggaactcgatccggccggccccggccgggatgggggtggcgtcgggcttctcggcgatgcccggcgccaggtcgagcacctcgaacacccggtcgaaggagaccagcgcgctcatcacgtcgacccgcacgttgctgagcgcggtcagcggcccgtacagccgggtgagcagcagcgccagggtcaccacggtgccggccgagacgtcgccgcggaccgcgagccagccgcccagcccgtacgtcagggcctgcgccagcgacgcgaccagcagcatggcgacgaagaaggtgcgggagaacatggcctgctgtacgccgatgtcgcggaccctggcggcgcgttcgccgaacttggcggcttccgtgtccgggcggccgaacagtttgaccagcagcgccccggagacgttgaagcgttcggtcatcgtggcgttcatcttggcgtcgaggttgtacgactcgcgggtgatctcggcgagccgcttgcccacccggcgggccgggatgatgaacgccggcagcagagccagggacagcacggtgatcggccaggacagactgaccatcaccaccgcggtcagcaccagctggatgacgttgctgagcaccccggagatggtcgaggtgaacgcccgttgcgcgccgaccacgtcgttgttgagccggctgaccagcgcaccggtctgggtgcgggtgaagaactgcaacggcatccgctgtacgtggtcgtacacgcgggtgcgcaggctgaggatgacgccctcgccgatccgcgccgaataccagcgctgggcgagggagagcagcgcgtcggcgatcgccaggccggcgatgaacagggcgatccggatcaccgtgacggacgccgcgggaccaccgcgggtgatcgcgttgatcacgttgccggccagcagcggggtggccaccccgatcaccgcgtcgaagaccacggccaccaggaagaccgcgatgtcgcgccggtacggctcggcgaagcgcaggatccgccggctggtgcccggcttgatctggtgtttcgccaccttgtcggcactctggatcgatcgcagcatgttccagctggtcatactcaagttccgcacctcccgggcgtcgcggcgactacgacaacccgggaggtggggccgctattccttactccccgcgtccggagagttcggcgagccggcgggtctgtgcctcccgttcggcccggtcctgctccggatagctccgcccggaggcaccggccagcaggcccttgatctcggccaccgcgttccggtcgccggccaggacggcggcggccagatcggcgaccgccgcgtccaggtcggcacgcggcaccaccgcggtggcgaggccgacccggtcggcctcgtccgccgggatccgccggccggtcacacagatctccagtgcccgggacgggccgaccagctcggtgagccgtttcgtcccacccaggtcgggcaccaggccgagggtgacctccgccatggagaaccgtgcgtcgtcggcgagcacccgcatgtcgcagttcagcgcaagctggaacccggcgccgatcgcatggccctgaacggcggcgatggacacgatggacggacttcgcaaccacgtgaacgcggtctggaagccggctatccgatccgcgcagtcggtggcggacaactgcgccagacgagccagtgaagaatcgccgtcgccgcgggcgaccgacagatccaggccggcggaaaacgcgcggccttcggctcgcacaatgacgacgcggacgtcgccaggcaatttccgggaaatgtcgctcagctccgaccacatggccggggtctgtgcattgagaacgtcgggccggcacaacgttaccgtcgcgaccggcccgtcctgttcgtaacggacgccgacctcgccggcggcgttgtccgccgtcacgccttcttgcggcggcgggcgccgccacgctggcgcaactgcacaccggattcggtgagcacgcggtggacgaatccataggaacggccggtggaagcggcaagcgcccggatgctctcgcccgaggtgtaacgcttcaccaggtccttggcgagcgactgccgctcgctaccgacgattcgacgacccttctcagtactggtagctgtgccagtggctgccatcttgaatcctcacgtcgcagacagtgcggtcagatacggtcccacctattacacaacctccaacgatcatgcgccaggcatctcgcgtcgaggaacgtgcccatttattactgtcaggaacttgacggttaccaccagcatcaatgtcagaccgtttgccggccgttgctccccgtgccattccggcccgccccggccgacccggaaggctctccaagaccatcgatcacctgcggaaacaggtgatcgaggcagcaccgtccgagaccgcccggacacgctgcgcaccggctgtccgggggtggtaagggacggcgggcgcgtacgggctcaagtccgacctgcccgcaaacgcccgaacatcgcactgtctgtgtgagcgccagttgacaactgacgatgccgatgatcctggatctccggaccggctcaggcgagctcgacgagctccagcagatcgtcgctccaggcgtcctcgtcgccgtcgggcagcaggatcgcccggtccggcttcagcgcctgcacgcagccggcatcgtgggtgaccagcacgatcgcgcccgggtagttggcgatcgcgtcgagcacctgctcccggctgaccgggtcgaggttgttcgtcggctcgtcgagcagcagcacgttcgccccggaacagaccagggtggccagcgccagccgggtcttctccccgccggagagcacgccggccggcttgtcgacgtcgtcacccgagaagaggaacgcgcccaggatcttgcggagctcggtgtcggtctgctccgaaccggcgctgcgcatgtggtccaggatcgtgcggtccacgtccagcgtctcgtgctcctgggcgtagtagcccagccgcaggccgtgcccggcgcgcacctcaccggtgtcggactgcagcatgccgcccaggatccgcagcagagtggtcttgccggcaccgttgagacccaggatggcgacccgcgagccgcggtccacggccacgtcgacatcggcgaagatctccagcgagccgtacgacttcgacaggccgtgcccggtcagcggggtcttgccgcacggggccgggctggggaaccgcaccttcgccaccttgtcggagctgcgcacctcctccaggccaccgagcagtttctcggcgcgcttggccatgttctgcgcggcgaccgtcttggtggccttggcacgcatcttgtcggcctgggccatcagggcgccggccttcttctccgcgttggcgcgctcacggcggcggcggcgctcgtcggtctcgcgggcctccagatacgtcttccagcccatgttgtacatgtcgacgaccgcgcggttggcgtccagataccacaccttgttgaccgcggcgtcgagcagctcgacgtcgtggctgatcacgatcaggccgcccttgtgctgcgccatgtagccgcgcagccaggcgatcgagtcctggtcgaggtggttggtcggctcgtcgagcagcaggatgcccttgccgttctgcccggagttggcgaacaggatgcgggccagctcgatccggcggcgctgaccgccggagagggtgccgatcgtctgggccagcgcgcggtcgggcagccccaggttggcacagatccgggcggcctcggcctcggcgccgtagccaccgagcgcggagaactggtcctccagctggccgtagcgccggaccagcttctcctccgagctctcctccagctggacctcgagcttctgcatctcggccaggatgctgtccagcccgcgggcggagagcacccggtcgcggccggtcacgttcaggtcaccggtgcgcgggtcctgcggcaggtagccgatctcgctggtccgctccacctgaccggcgtaggggatgccctcgccggccagcaccttcagcgtggtggtcttgcccgcgccgttacggccgaccaggccgatccggtcgccgggctgaacccgtagggtggtcggggacagcaggatccgtgctccggcgcgaagttccagtccggtggcggtgatcatgaagtcttatctcgctctcggggatcgggctgactcggggcgcaacttgaatcggcaggtcagccttcgcggagcagcacgcggcaatagtacccgccccccgctgacacccggcagccgattaagtcgcaagatcatcgggtactcgcccggcaaccttggcgaagtggggacgagatggagctgaacgagaacgccgagatcgacaccagtcaggtcgaggacgtgcgcggatccggcggtggcggtggcggcttcggcggcctgccgatcccgatcggcggcggcggactcaccggcatcatcatcaccgtgatcctgctggtggtcggcggttacttcggggtcaacaacctgggcggcggcggcggcggaggctcctccaaggccgacaacaccaagatcagaaatgagtgcaagcagtccgacaagctccagaagctcgactgccgcaacgtgctctacatcaattcgatccaggcatactgggccaccgagatgccgcaggccttcggcaagcagtacgagaaggtcaacaccacgatcttccggagccgggtgaacaccggctgcggcgccgccgactcgggcgtcgggccgttctactgcccggccgacaaccacgtctacatcgacctgacgttctacgaccagctggccaaggagctcggcgcgccgggcgagttcgcgcagccgtacgtgctggcccacgaatacggccaccacgtgcaggacctgctgggcaccgaggccaagatgcggcaggcgcagaacgccgacaagagccaggcgaacctgcagtcggtgcggctcgaactgcaggccgactgctacgccggggcgtgggccaagggcgcgaccgggaccgccgacgccaaggggaacaaggtgttcacgagcctcaccgactcggacatccagcagggcatccagaccgccgggcagatcggcgacgacaccctgcagaagcgcggcggcggcacggtcaacccggccgagttcacccacgggacgtccgccgaccggcagaagtggttccgcaccggctacgactcgggcgacccgacgaagtgcgacacgttcgcgccgggggcggtcaacgagggcgactgaccgccgccgcgctccggacatccggccgccgacccgcacctggcgcgggacggcggccggagccgttccctgtcgcggaacccgggcgaccggagccgccgcccgtcgcggaacccgggcgaccggagccgttcccgcgggagggtccggggcggtcagggctcacggatcaggatcgggaccgcgcgggccatcgcgatcgccgagaccagcacggcgtggcgcggctccgggacgtccagcaggcggccggcccgcagcgcggccagcggggccaggacccggtcggcgaggatcgcctccacggcggcccggtcgccgccggtgaccagggccgtcagcgtacgcacctcgggcaggaggatgcgtccgacgatcccggcaccgtccgcggcggccgctttggcctgattgtcccgccggcgcgcgaaacgctgctgcgaccagccaccggccgctgtccggccttgcacatagtgcgtgtccaccttggacatcaccagctcgccgccgtccaccaccccggccgcgaccgcccccttacgcgccagcagcaacccgaaccggcgcggcgccagggcggcggcggtcagctcggccaccgtcgccggctcccccacgccgggcggggcgtgcagcgacgcttcggccccgtcggcggcgatcaaggtcaagccgatttcccggtacggcccgtgccgggtaccgaagttctccagccagcgccccacccgctcgggcgccacatccacccatttcccgccaccggcggccggccgttcacccattctcgccaccctacggcggccgcatccggcccgctcccgccccgcggcagggtcaccgttctactcggatcccgatggcacgatccggccccgcgccgcagcgcggtcgccattctcatcgggtccagtggcaggatccggccccgcgccgcagcgcggtcactagctagctaggccattctcgtcggacccagtggcaggatccgggccggccccgccccgcggcgcggtcgtggttttttgtcggaccccggtggcaggatccgggcatgagcttgaccgaggtggtgatggcgcggctgaccacggctttcgaggcggcccgcgacccggtgcgggccccggcgatggcggcctacatgcgcgatcagttccggttcctcggcctgagcgcgactgcccgccgtgccgccgcccgcgccgtcctggccggcctgccccgccccgacgaggcggtcctggttgacatcgcccgggcctgctgggctcgcgacgagcgggagttccagcagttcgcctgcgacttcctaaccgccggcctgccggccaccagcccgggttccctcgccctcgccgaggagctgatcaccacgaaatcgtggtgggacacggtcgacccgctcgccacccacttcaccggcggcctggtccgccgacatcccgagctgtgccgccggatggacgactggtcggccgccgacgatctgtggctgatccgcaccgcgatcctgcaccagctgcactacggcgcggcgacggacaccgaccggctcttcgactactgcacccggcaggccggccacccggatttcttcgtccgcaaggcgatcggctgggcgctgcggcactacgcccgcactgacccccaagcggtgcgggcctacctgaccgcccacgccgcgcgcctgtcgccgctctccctccgggaggccgccaagcacctgtaggttcagccggcccgtgtgcgaggctcatcgaacgaccggtccggcgctcatcgtgtcgccgatgaggctcatcgaacaaccgatccgacgctcatcgcgtcgccgatgaggctcatcgaacaaccgatccgacgctcatcgcgtcgccgatgaggctcatcgaacaaccgatccgacgctcatcgcgtcgccgataagattcatcccgcagacgtcagtgacggctcgccgcgctcggcaacccggccgggcgcccggtgctcgtccagcgcgtgccacgccgaggagacgaacggggcgagcgtgaccagcagatatccgatgccggcgagcagcgccccggtgcgcaggccgaggtcgtcggcggcccagccgccgagcacgccgccgagcgggatgccggcccaggagaaggcgatcagcacgctcatcacccggccctgcatccggaccggcacccgttcgtagacggcggccagcaggatcggattgatcgacgccatcagtgtcccggccagcgcggcgatcgccaggaccggccacagacggtcgctcagcgacagggcgaacagttgcgccggcccgccgagcaggaagcagacggcgaaggtggagcggcgcggcagccggggaccgacgatcgtccagaggatgttgccggccaccgccccgatcccgaaggcgctgcccagcacgccgagcgcggccggcccgtgcgggccctcgcggacccagaccgggacgaaaaccgtggcgtacgcctggtcgaagaggttcgtcacgaacagcatcgacatgatcccgatgatcagccgatcctgtcgcacatggcggaatccgcagcgcagcgccgccgcgtacccgccctcctcgtcgtcggcgggcggctggccggtcgagccggcccggacgaacagtgtgatcagcagggcgcaggcgccgaacgaggcggcgtcggcgagcagcacccgggccgggccggccgccgccaccagcagcccggccagcggcagcccgagcagcgtggcgacccggctgatcccgtcgtacagcgtggtgccgcgttcggtgctcagcccggcggccgcgatcacccggggcagcagcgcccgtttggccgtgtcgccgaagccgcgcagcgccccggccacggcgatcaggacgagcagcgtgtggtacggcaccgccccggtggcgtagaggaccgggatgccgatgaccgcgatcatgctggccacgtcggcggcgaccgcggtgggacgcggtccggcccggtccacgatcgggccgccgagcagcccggccagcacgtacggcagcatctcggcgaagccggcgacaccggcgagcagcgccgacccggtgctggtcagcaccagccagggcagcgccacgaaggtgatccggctgccgagcagggagatcgcctcagcggcgagcaggccggccagtcctcgcctcaccctcggttccttctccgggttcgccactgtacgacgacctgcgggcatcgaaccaacctatccgtgcaaagcggcctttggaagacacaggtcgatatgttgtccaagagtcaggccggtgggaggtggtcgatcacgttgtaccggtcgagccggagggttccaccgtcgtcggtgaaccgggtgatcgacgcgttgcgcaccgcgcccgcggacttctccaccgcggccagctcttcccagtccagatcctcgatgacggcgcgggtcatcagcaccaccgcgtcgtgcgccaccacgagcacgcgccggccggcgtgcgcacggtgcagatcatccaggaacgacgtcagccgcacccggatgtccgcgaacgactccccgccgggcgggcagtactcccacgggccggcctcggccagccgcgccgcctccccggggaaccgggcggccaccgcggcccgggtcagcatctccagatctccgagcagacgatcgacgagacgatcgtcggtacgcggttccggcagcgccacgcccgccgctcgcgccgcgatccgccaggtctcccgggcccgcagatacggcgaggtcaccaccacctcgggacgggcgtccgccggctgcccggccagccaggcaccgaccgcccgggcctgcgcctcgccccgctcggtgagcggcacctcggcgtccggcccgctcagcgcgatctccagcagttccccctcgtcggcctgcgggaagagcacgttggccaggctctgcccgtgccggatcaggatcagttcggcgaccacacccatgatcggaccctaaccgtgacacaccgtcgccgggaagaagcccggggtaggcgaccctgggcacccgggtgccccgccggcctggcggcaaccggctcgccgggcggaaaatcgctggcccggcgggcctggcgggtcgcatgatgacgccgtgaccgtgctgagagccttccccgccatccctgtcgccgccgacgtccggcccgcgcgacagcagccggcccggcacggaacggcggtgcccggccagcggtcatgagcgccccgttcctggccggcgtcgtcgccggatacgggatcgcggtgccggtcggcgcgatcggtgccctcatcgccgggctcagtgcccgcacctcgctgcgggtcggcgcggccgccggcctcggcgcggccaccgcggacggggtgtacgcgtgcgtcgcggtcgccgggggcgcggcggtggccggggtgatcgccccgatcgccggtccgctgcgctggctcggcgcgctggtcctgctggcactggcgggctggacggcgtggggcgcgatccgccacccgagcaccggggcccgcgatgagcgccccacgacgccgctgcgcgcgtacgccgcaatcctgggtttgaccctgttgaacccggcgaccgtgatctatttcgcggcgctggtgctggccgacggcggcgccggcggcgggccgtggttcgtgctcggcgcgttcctggcctcggcgagctggcaactgctgatcgccggcggcggctcgctgatcgggcggctgctcaccgggccgcgcggccggttgatcaccgccctgtcgtccagcgtggtgatcgccgtgctcgccgtccggctgctgacgagtacctgaggcgcgcccgggcggcggccaccgtctgaccgcgaaaggtcaggcgccgcggaggaatccggcgaccttctgggtgaaccagtcgggatcgtcgagccacgcgaaatgaccgccgcccggcaccatcgccaactcggcgtgcgggaacaggccggcgtactcggcggctgacttcggcggcagctgcaggtccatctccccggagatcagcagcacagaggcttgcagggcggcgagcccggcccgtacggccgcggggtcgaaagcgccctcggcgttgtaggccgcggccgcgacccggttcttctgatcggcctcgcgggccgaataggcctgcgtcccggcatcccagcggccgtagatgaacggggccagcgcccggccgtcggcagcggtggcctgaccggtctggatccgttccagggcggcgaacgcctccgggaaccacggctccgcgcgccgctcctcggcgacccgccgccggtccaggtcgctgatctccagcgagaccgcccgggggctcggattgacgaggatcagccggcgtacgcggtcggggtgcgcgacagcgtagagcagcgccagactcgcgccggccgagtggcccagcaggtcgaaacgctccaggcggacccgctggcgcagcgcctcgatgtcgggcacctgacggtcgcagcggtaggtgtccggatcgtccggcggcggcgagtcgccggtgccgcgcagatccgggatgagcagcagacggtgggcggacaggccgccgaggtcgccgagataggtggaggcctgcatggggccgccggggaggcagaccagcgggtcgccggagccggcgcggtgcagggccagccggagaccgtcgggggcgatgaaggtgtccacccggaaatcctatgcgcgaacgtcgatccactggggacccgccgcgcccgtccccccgccgggaccgtcgatcgcgcggaattgtcggtgggccggtctaggctcacgaccgtggttgcgttcaccggtgacttcgagacccacctgaccgccggggccgggcaggtggcggcgctggccgcgttcgccgccgagcacggcctcacgttcctgcacatcgagctggatcgcggcgtgacgacctcgcagccgatgctcaccctgcgcggcagcggtggtctcgccgaccggctcgacgtcgcccaccagtggtgccggcggctgcgcgaggccgggatcacccccacccgggtgaaaatcgaggcgtcgccgtggaccgacggggtgccgcagcacgacgaggccgccgccgaccagcccgcctaccgctatttcgagcaccatctgaagctgcgcctcccacccgggatggccgatctgatcgcgctgaccgacctcgtcgagccgcacggggcgcggctgtcccgcaacgccctgaagcgttccgccgacggcgccgagatccgcttcgtcaaccagcgctgccatcgcgtcgggctggcgtcggccacctcgcggctggaccgcctggtcgccgcgctgcgggacgccggccacgacatcgtctcggtcgagcaggaatacgtggtgcacgacgacaacctgcggatcgacgacggctggctgccccgggaggagccggtcgacacctcgtggacgccgagccggcgctgaccctgatgcgcggcatcgcccgcgccgtcgagcactcccccggcaccgggccggcgctgaccctgatgcgcggcatcgcccgcgccgtcgagcgctcccccggcaccgggccggcgctgaccctgatgcgcggcatcgcccgcgccgtcgagcgctcccccggcgccgggccggcacccggcgcggtcaccgagtccgcgatcgcgacctacgagcgggccgcgcggcacgccgcctgatgatccgcgttccgcggcgcccggatcccggacggcggcgtgccgccccgggagcgcaccgcggcgccgggcggacaggcacgacccgtgatcaaccgggaagcgaggttgctcggaggaaccgcgggcggaggcgccggggcccgccatgcccgggccgacgtgcccgcgggtggccgggccgccgggtcggtggcgttgggactacgaccaggcgttgatttgggtggcgacctcgcggtcgccgtcgatgcggacggcgtccagcgggatgcggcggtagaggtgcaggaccaggtcgctggcggtgccatggacacgggtgacgggttcgccgctggccgccgggtcggcggtggcgccggccggggacaggtcgagggtccaggaggggccttcgacggcctggtactggacccgggccgggcggtgcggccaggcgccgcgcgaaccgaggccggtcgccaggaactcgctgaccccgtcgacggcgatcgcggccggcagtggttccgccttgccgagcgcctccatcgcgtcgaaggcgtgcaccgcggcctcctgcacctgatgccgggccaccgcggccaccgtgtgcggcgccgcctcgaccggccaccacgcccagcacggcgtgtccggcccggcggcgcgcagggcggccccgagcagccgggtcgactcgcccaaccactccagcaggtcgctctgcgggaacgtgctgccgtaccgctcccggggcggcggcccggacgggtccgcctcggtcaccaccagcgcccagaaacgctgcacctcgccgaggtgcgcgaccagatcacgcagcgaccagtccgggcagcccggcacccgggctcccatgtccggcgcggcggcggccgcctcccgcagcgccgcggaacgctcctcgaccagcgtgacaagctcggagaagggcggagtcggagtcatccccggtttctaccaccggaaacgccgcgtccctccagaaatggcatattcaccctgaaacgtcgcgacttcgccatccgccggaaaccttccaccgatcatcaccacgtcgctacttcgccatccgccggtagaccctcaccacgacgaaaggcggcaccccgaatccggggcaccgccttcgtcgtgtcggtgtcagacgttgaagccgagggcgcgcagctgctcgcggccgtcgtcggtgatcttgtcggggccccacggcggcagccacacccagttgatccggaagtcctggaccaggccgccacccgggccggtggtcagcgcctggcgggtctggtcctcgatcacgtcggtcagcgggcaggccgccgaggtcagcgtcatgtccagggtgaccacgttgtcgtcgtcgacgtgcacgccgtagaccaggcccaggtcgacgacgttgatccccagctcggggtcgacgacgtccttcatcgcctcttcgacgtcgtcgaccgaggccttcttcccgggcgccgccttctcaccggcgaccgcgacaccggcgaccgcgacaccggcgaccgcgacaccggcgaccgggtcaccggcagccgagtcaccgttcgccgagtcaccgttggccgaatcgccggcggcggccccggccgacacgccggcagccgggacctcgaccggctcgccggaggcggccgcagcggcccgctcctgcgccagccacgccggaacctcgtcgtcagcggccgacgtcacgccggccggagccgacgccacggtccgcgcggtgtccccctcggccgcgtgcgaatgcccatgcccgtggtcgtgcccgtggtcgtgcccgggaccaccggcggcgtggtcatgcccgtggtcgtggccgtgatccccgtggttgtggccctcgtgcccgtgaccatcgtggtcgtggtgggcgtggccgtgggccacggtctgaacggattcggtatcgctcatgccttcacctccgggctcgcgcccacctcgacgccggcccgtaccgccgcgtccttgaatgccatccacggcagcagggcacatttgacccgggccggaaacttcgcgacgcccgcgaaggcgatcccgtcgccgagcacgtcctcgtcgggttcgatggcgccacggctctgcatcagctcgacgaacgcgtggtggatctcggcgacggtcgccgcgtccttgccctgcagcagctcgtgcagcaccgaggcggacgcctggctgatcgagcaacccaacccgtcgtaggagatatccgagaagtcggaactgacccggacggtgatctcgtcgccgcacgtcggattgacgtgatgcgcctcgccatcgaaaggatcccgcagcccacgcccatgcgggtgcttgtagtggtccaggatgatgtcctggtacagcgcgtcgagcagcatcagccgaacaccttccgcacctggtcgagaccgcgcgccagggcgtcgatctcctccgtggtcgtgtagaggtagaacgaggcccgggtcatcgccggcaccgcgaagcgcacgcacaccggccgcgcgcagtggtgcccgacccgcacctcgacgccgagcgcgtccaggacctgcccgacgtcgtgcgggtgcaccccgtcgacgccgaacgacacggtgccgccgcgtcccaccggagacgcggggccgaagatccggacccccgggaccgatccgagctgttccaacgcgtacgccgtgatgtcctgctcgtgccggtggatgttgtccatccccagcgcggtcaggtagtcgacggcggcgcccagcccgatcgcctcggtgatcgggggcgtgccggcctcgaaccgggcgggcggcggcgcgtacgtcgtcttcgccatcgtgaccgtctcgatcatcgagccgccggccaggaacggcggcatctgcgcgagcaggtcgaacctgccccagagcacgccgatcccggtcgggccgagcatcttgtgcccggtgaacgcgatgaagtcgacgccgagcgcccgcacgtcgatcggcaggtgcggcaccgactgggacgcgtccagcatgaccagcgcgccgacctgccgggcccgctcgacgagccgggtcacgtcgttgatcgtgccgagcacgttggacatgtgcacgaccgagacgagcttggtgcgctcattgaccagcgcgtccagctcggactcgtcgagccggccctcgtcggtgatgccgaaccagcgcagcgtggcgccggtccgctcgcagagcagctgccacggcaccaggttggagtggtgctccatctcggagatgacgatctcgtcaccggggcccagccgcaggaacgagccggccgcgtgcgcgaccaggttgatcgcctcggtggagttcttggtgaagatcacctcgtcgggcgtgcccgcgccgatgaacgacgcgatcctggcgcgggcgccctcgtacatctcggtcgactcggtgccgagcgtgtgcaccgagcgggacacgttgccgttgtgccgctcctggtgcgcgcgcatgacgtcgagcacctgcaccggcttctgcgaggtgttggcgctgtccaggtagaccagcgggtggccgttcacctcccgctcgaagatcgggaagtctttgcgcacccgcgcgacgtcgtagctcatcgagtctctcctcaggccttggccaggaacttctcgtaaccggagacctcgagctcctcggccagctccgggccgccctcctcgacgatcttgccgccgacgaagacgtgcacgaagtccggcttgatgtagcgcaggatccgggtgtagtgggtgatcagcaggaagccggtctcgccggtctcgcgcacccggttgacaccctcgctgacgatccgcagcgcgtcgatgtcgaggccggagtcggtctcgtcgaggatcgccatcttcggcttgagcagctcgagctgcatgatctcgtgccgcttcttctcaccgccggagaagccctcgttgacgttgcgctgcgcgaacgacgggtccatctgcagcttctccatggcaccgcgcagctcgccggcccaggtgcgcagcttcggcgcctcgccgtcgatcgcggtcttggcggtgcgcaggaagttcgcgaccgagacgccggggacctcgaccgggtactgcatggccaggaagaggccggcgcgggcccgctcgtcgacgctgagcgccagcacgtcctgcccgtccagggtcaccgacccgccggtgatctcgtacttcgggtgaccggcgatggagtacgccagggtggacttgccggagccgttcgggcccatgatggcgtgcgtctcgccggacgtgatggtgaggtcgaccccggccagaatcggcttcagctcaccatcgggcagcttcaccgaaacctgcaggtcgcggatctccagggtgctcacggctgtactccattgctcggtgtcgtggaaacgtggatgtctccgtcgcggatctcgacggggtagaccgccaccgggtcgatggcgggcggtccggagggctcgccggtgcgcaggtcgaagcgggagccgtgcagccagcactccagcgtgcacccgtcgacctcgccctcggagagcgccaccgaggcgtggctgcactcgtcacggaccgcgtagaaggtgtcgtcgtcggcgtgcaccaccgcgatctcgacgccgtcgacctccacccggagcgcggtgcctttcgcgatgtcggacgccggcccgacgttctcgaagctcactatgccccggcctccaccagacgggcctcgatcgcgtcgccgagccgctcgcgcagctcctcgaccgggatcttgttgatcagctcggcgaagaagccgcggaccaccagcttgcgcgcctcgccctcggggatgccgcgagccatcaggtagaacagctgctcgtcatcgaaccgcccggtcgcgctggcgtgcccggcgccggccacctcaccggtctcgatctccaggttgggcaccgagtcggcccgggccccgtcggtgaggatcaggttccgattgatctcgtacgtgtcggtcccggtggccgccgcgcggatgagcacgtcacccacccagacggtgtgcgccgacgtcccctgcagcgcgccccggtaccccacgtggctgcggcagtcgggcacgctgtggtcgaccagttggcggtgctcgtggtgctggccggcgtcggcgaagtacagcccccagagctcggcgtcgccgccccgcccggcgtactccacgctggtgaactgccggaccaggtcaccgccgagggtgacctgcacgtgctgcacccgggcgtccttgccgacccggaacttcacgtgctgggcctgcaccgcgtcggtgtcccactcggccagcgtcacgaaggtcagctgggcgccgtcgccgatgatcacctcgacgttgtcggccagggtgaccgtgccggtctgctgcagcacgacggtcgccttggcgaaccggccgacccggaccacggtgcgcgcggccgcggccgcgccgcccttgccgaccagccggatcacggccgcctcggtgggctcggcctcggcggccacctcgatcacggtgacggtggccgccgagccgtaggccagggcgctgatccggtcgaacggggtgagcaccgggtcgacgtcggcggcggtggacaccgtgacgccggccggcaggtcgccgtgctccaccgacggggccgcgccgtccagcttggtggccttgaccaggtcacgcagccgcttcagcggggtaaaacgccactcctcctccaggccggtgagggccgggaagtcggtgacgtcgaaggagcgcagcacctgcgacttggtgctcggcggggcgatggtagtcatttcgtcctttatgtccgctgtcggcccgggtgattaacccacggccccttccatctgcagctcgatcaggcggttcagctccagcgcgtactccatcgggagctccttggcgatcggctcgatgaagccgcgcacgatcatcgccatcgcctcgtcctcggtcaggccgcggctcatcaggtagaagagctggtcctcgctgaccttggagacggtcgcctcgtggcccatgttcacgtcgtcctcgcggatgtcgacgtacgggtacgtgtccgaccgggagatcgtgtcgaccagcagcgcgtcgcacttgaccgtgctcttcgagtgcgcggagccctccagcacctggaccaggccgcggtacgacgtgcggccgccgccccgggcgatcgacttcgacacgatcgtcgaggaggtgtgcggcgcggcgtgcaccatcttggcgccggagtcctggtgctggccctcgccggccatcgcgatcgacagcacctcgcccttggcgtgcgggccggtcatgtagacggcggggtacttcatggtcaccttggagccgatgttgccgtcgatccactccatggtcgcgccctcctcgcaggtggcgcgcttggtgaccaggttgtacacgttgttcgaccagttctggatggtcgtgtaccggacccgggcgttcttcttcacgatgatctcgacgaccgcggagtgcagcgagtcggacgagtagatcggcgccgtgcagccctcgacgtagtgcacgtagctgccctcgtcggcgatgatcagggtccgctcgaactggcccatgttctccgtgttgatccggaagtaggcctgcagcgggatgtcgacgtgcacgcccttcggcacgtagatgaacgagccgccggaccagacgctggtgttcagcgcggcgaacttgttgtcaccgaccgggatcaccgtgccgaagtactccttgaagatgtcctcgtgctgcttgagcgcggtgtcggtgtccaggaacagcacaccctgcgcctcgaggtcctcacggatcgcgtggtagacgacctccgactcgtactgcgcggcgacaccggcgaccaggcgctgcttctccgcctccgggatgccgagcttgtcgtacgtcgccttgatgtcctccggcagctcctcccaggaggcggcctgcttctcggtggaacgcacgaagtacttgatgttctggaagtcgatcccggtcaggtcggcgccccagttcggcatcggcttgcggtcgaacaggcgcaggcccttgagccgcaggtcgagcatccactgcggctcgctcttcttcgcggagatgtcgcgcaccacggcctcggacagaccccgcgtcgcggcggcaccggccacgtcggcgtcggcccagccgtactcgtacttgccgagggcggccaggtgctcttcctgagtgacgatctggtcagtcatcgctatctgtcctaaccgtggttgcggggttgtgcgtcgagccggccgggatgtgcgtggtgcacaccccgtcgccgtgcgcgatggtggcgaggcgctgcacgtgggtgccgatgagccgggagatgacttcggtctcggcgtcgcacagctgagggaactcggcggccacgtgtgccaccgggcagtggtgctggcacagctgcccgccggacgcgatcgtggtcgcgctggcagcgtagccctcggcggtcagcgcgtcggcgagcgcctccgcccgggtgatcgggtcggcgccggcctcgtcgagggcggtgcggcagcggtcctccagcgcgcggatctgcgacccggcgaacgcggtgaccgcctccggcccgttgtgctgcgcgatccagcgcagcgccgcggcggcgatgttgtcgtagtggtgcggcaggctctcccgggcggcggcggtcagcacgaacgccttcgccgggcgaccgcggccgcggggcccggtgcgccgcacctcgcgggtctcgaccaggtggtcggcgagcatcgcgtcgaggtgcttgcggatcgccgcggggctgagaccgagctgggcgccgagctcggccgcggtggccgcgccgcgctccagcagcagccgggcgacccggtcacgggtgcggccgtcggatgccgcggctgacgccgccgcaccgtctttggccagcacaccgtttttcactacgccaacgttacgtatttcctcgggagcctgcaaacccggccccggtgatccaccacaccggcccaaggagcaggaaaaatcaagatcggattcgcgcgtacgattccccgggtgaagttgttgccgaccctcacccgcccgttcgccgcctggctgcgcccgctcgccctggcgaccctggtggccaacgtcgcgctgatcgtcaccggcgcggcggtccggctcaccgactccggcctcggctgccccacctggcccaaatgcaccgacgagtcgtacacgacgaccgccgcgatgggcgtgcacggcgcgatcgagttcggcaaccggctgctcggtttcgtgctggccgccctggccatcgccggcttcctcggcgcgctcggccggcggccccgccgccggtcgctggtccgcctctcggtcgcggccggcctcggcgtcccgatgcaggcggtgctgggcggcatcaccgtgctcacccacctcaacccgtgggtggtcggctcgcacttcctgctctcggtcgcgctgatcaccgtctcctacgccttctggcgccggatcgacgacggcgacgccgcaccacgcgccctggtccccgcgcccctgcgcccgctcgccgcgatcaccgccctggccagcctggcggtcatcacggtcggcacggtggtcaccggcagcggcccgcactccggcgaccgcggcgccaagcgcaacggcctggacccggccgccgtctcccaggtccacgccgacctggtcttcctgctgatcggcctctcggcggcgctgtggttcgcgctgcgcgcggtcccggctccggacaccgcggtccgggcggccgcggtgctggtcgccgtcgagctcggtcagggtctcatcggcttcgtccaatatttcacgcatctgccggtcgtcctggtcgccgcccacatgctcggcgccggcctggtctggtgggcgacgctggcggtcctctggtccctccggacgcgcgccgccgtcgccggcgacctcgagaccacgacgacgccggctccggaaccggttccggccgcatagcgagccaccatcgagatcagggccgcatcgcagatggcgtacgcgccggccgatgaccgatcgccgcccaccggcgcgaccggtcacggcgatcggccgctgcgcgtgcagaaggaatcgccgcgcccgtccacagccgccgttcggcgcggtcggcacgccgacccaggcaggctgccctcggtcgtaccgacagaccgtggaagccggaaccggcggacggtcagagacgcgcgaggacggcgtcggccagacggtccgcggcacccggagcggtgagcaggaacagccccggctcgctcagctccagctcgatgacctgcggcgccccatccggaccggggatgacgtcaacccgggcatagagcagccgcttcgacccaccgggcaccgcggtgagcgccagccgggccacctcccgctccgcctcggatgccgtccgcggcgtgatctcctcgctgcccacgtcgatgacgtgctcgccggtctggcgcagcatcggccctttccggatggcatggctgaaggccagctcaccggactcgtccgggaagaacagcagcgccgtctccccctcggtggcgaccgccgccaggtacggctggaccatcgcggtccgcccctcagcggtcagcctgccgacatgcgcctgagcctgcgccgcttgagcgggcaggcggtagcgagcggtgtcctggctgccggccgagactgtcggcttgaccacccactcaccgctggacggcggggtccaggcctccccgggcccgacgaagccggtcgggatgaccggaacccccgcggcggcaagctcaccgatgtaccgcttgtcggtgttccagacgatgatgtccgccgggttgagcagccgcgggacgctccgggcccaggcgacgaactgttcgtggcgggcgacgtagtcccacggggagcggaccacgaccaggtcgtagcccgcccagtcggcgtccggctcgtcccagcggacggcgtcgacggccacgccgcgcgagcgcagggcgtcgcgcagcgggtggtcgtcgtcccagaggtcggggaaggccgcgcaggtgaccagggcgacccggcggccggtgggcatcagcgcgccatgctccggcgcgccatcgaccgccacaggtcgttgctgggacgcatctgctccaggagttcgcgctcccactcgttctccacctcgacgccggcgtgctcgcacgcctcgcgggcgacaccggtgtcctgggcgaactggtcggaccactcgccgtccccgccgacgaggacgatgcgggcgccgcgcttaccgacgtactcgatgaccgccttgcagccgccgtgaccggcggcgaaagacttgatctcggaggtcagcgtcattacggaaccttctgccatgtctcgcagcctaagcaatcagcgagggttcccgtggtacccgagagcccttttgtgactcctgttacctgcgggtttgccgataggacatatagttttaagccaatagcgcccgatttgcacgattaccggattccgtcgaacgagtgacggacagtagttgacacgcatcacaatccgggcatcgtgtgcgacttgtccgttgcggtgtgtaccgaccgcgatctcagaccagtgcgtcgacggcgatcgccatgaagagcaccgtcaggtaggtgatggagagctggaacagccgcatcggcttcaccatgccgccgttgcgggtctggtagaccagccgcaccgactcgccgaggaacagcacaccggtgatcatcgcggccgagccgtagatccagccgagccccagcccggtccccagcggccaggcggccagcgaggaggcgacggtgagcacggtgtagagcaggatctcgaagttcacccgggccaccgagcgcaccacgggaagcatcgggatgccggcccgcgcgtagtcatccttgtatttgatggcaagcgcgtagaagtgcggcatttgccagaagaagacgactgcgaacaacgcccaccccatcggggcgatcgatccggtcaccgcggcccacccgatgaccaccggagccgccccgcagacgccgccccagaacgtgttcgccggggtccgccgcttcagccagagcgtgtagatcacgtcgtagtagaagatcgagaacgcggtgagtgcggtcgccagccagttggtcagcaccgccatcaacgccaccgagaccaccgccagcgccagcccgaagatcagcaccgcgcgggggctgatctgatggctgggcagcggccgccgcttggtccgcttcatcagcacgtcgatgtcgcggtcgatgtaacagttcaacgcgctcgccgcgccgcccgcgagagccccgccgaccagcaccgcgaggaaggtgaccaggtcgggccacccgccggcggccagcatcatcgtgggcaccgtggtgaccagcaacagctcgacgatcgccggcttggtcagagccaggtaggcccggaacaccgccatccgctcacgtcgggtctcctcgcgtggcgcaggctccgccacgccgggcgaccgtcgctggacggaacgctcggtgatcatgctcacggacagccaccttccggcatttggaccaactggcggccgcatgccgggtgtctgctgacccggccaagccgcccggacagcctacgcgccaccgtccccgctgctcggggcacccggcgcgggtggaggccgtcacacccctcaaccgtgtgtccgctcacagcgtatgtgcctacgccgttcactgcgcagacgtttagccctactggatagggtcaagccgaaaagggttccaaaaatcctgcccgaggagcacaacagacgtgggtgccaacgattcagctctccattggtccgacctcgaccgcaaggcggtcgacacggtccgggtcctggccatggatgccgtcgagaaggccggcaacggccaccccggcacggccatgagcctggcgccggccgcctacctgctgttcaaccgcgtgatgcggcatgacccgaccgacccgcactgggcgggccgcgaccggttcgtgctctcctgcggtcactccagcctcaccctctacattcagctcttcctcagtggctacagcacctcgctggacgacctgaaggcgctgcggcagtgggactcgctgaccccgggccaccccgagtacggtcacacccccggcgtcgagatcaccaccggcccgctgggccagggcatcggcaacgcggtcggcatggccatggcggcccgccgcgagcgcggcctgttcgacccgcaggccgagcccggccggtccccgttcgaccaccagatctatgcgatctgctcggacggtgacatcgaggagggcgtcagccacgagtcgagcgccatcgccgcggtgcagaagctcggcaacctcacggtgatctacgacgacaaccagatctccatcgaggacgacacccggatcgccaagtccgaggacgtcggcgcccgctacgaggcgtacggctggcacgtgcagaccgtcgactggcgctcgtccgacccctacgtggaggacgtggaggcgctctgggacgccatccaggcggccaaggcggtcaccgacaagccgtcgttcatcgtgctgaagacgatcatcggctggcccgcgccgaagaagcagaacaccggcaagatccacggctccgcgctgggcaaggacgagatcaccgccaccaaggcgctgctcggcttcaccgacgagccgttcgccatcgacgacgaggtggtcaagcacgcgcagcaggcggtcgagcgcggcaaggcggcgcacgccgagtggaacgaggcgttcgccgcctggggctcggccaacgccgaggccaaggcgctgttcgagcggctcgcggccaagcggctgccggagggctgggcggccgcgctgcccgagttcccggccgacgagaagggcctggccacccgggccgcgtccggcaaggtgctggaggcgctggcgccggtgctcccggaactctggggcggctcggccgacctggcggagagcaacaacaccacgatgaagggcgagccgtcgttcatcccggccgagtacgcgaccaaggagttccccggtcacgagtacggccgcacgctgcacttcggcatccgtgagcacggcatgggctcgatcctcaacggcatcgcggtgcacggcggcacccgcccgtacggcggcaccttcctggtcttcagtgactacatgcgcggcgcggtgcggctgtccgcgctgatgaagctgccggtcgtcttcgtgtggacgcacgactcgatcggtctcggcgaggacggcccgacgcaccagccgatcgagacgctgaccgcgctgcgcgccatcgtcggtctcgacgtggtccgcccggccgacgccaacgagacggcgtgggcctggcggggtgccctggagcaccacgaccggccgaccgcgctggccctgtcccggcagaacctgccgaccctggaccggtcgaagtacgcctcggccgagggcaccctcaagggcggctacatcctgtccgaggcgtcctcgggcaccccgaaggtgatcctgatcgcttccggctccgaggtggcggtctccctgaccgcgcaggagcgcctggaggccgagggcaccccgacccgggtcgtctcgatgccctgccaggagtggttcttccagcaggacaccgcgtaccagcaggaggtcctgccgcacggggtgaaggcgcgggtcaccgtcgaggccggcatccggatgagctgggaccgcctgctcggcgacgccggcgaggcggtctcgatcgagcactacggcgccagcgcgcccgccaagatcctcttcgagcagttcgggttcaccgcggacaacatcgtggcgaaggccaacgcctcgctggccaaggtcggcgtgatcaccggtcacacgaccggcaactgacaggagttgaaggtaatgaccgacagactggcagagctgtccgcgcagggtgtggcggtctggctcgacgacctctcccgggtccgcctgaccagcggctcgctcgacaagatgcggcgtgagcagcacatggtcggggtcaccacgaacccgagcatcttccagaaggcgctgtccgacgcggacgcctacgacgaacagctgcgcgacctggccgcccagcgggtcaccgtggaggaggcggtccggctgatgaccgccgccgacgtgcgggccgcggccgacgtgctgcgcccggcgtacgacgcgtccgacggcgtggacggccgggtctcgatcgaggtggacccgcgcaaggcgcacgaggcggaggcgaccgtcgccgaggccaagaccctgtggtggctcgtcgaccggccgaacctgtacatcaagatcccggccaccatggacggcctgccggcgatcaccgcgaccctggccgccgggatcagcgtcaacgtcacgctgatcttctcgctggagcggtaccgcgcggtgatggacgccttcctgtccggcctggagcaggcgaaggcgaacggccacgacctgtccaagatcggctcggtcgcctcgttcttcgtctcccgggtggactcggaggtcgacaagcggctcgacaagatcggcagcgacgaggccaaggcgctcaagggcaaggccgcgatcgccaacgcccggctcgcctacgaggcgtacgaggaggtcttcggcaccgaccggtggaccgccctcaagcaggccggcgcgcacccgcagcgtccgctgtgggcctccacctcgacgaagaacccggacttcccggacaccatctacgtcgaggagctgatcgcgcccggcacggtgaacaccatgcccgagtcggtcatcgtggcgtacgccgaccacggcaccacccgcggcgacacggtcaccggcaactacgccgacgccaagcaggtcttcgccgacctggcgaaggtcggcgtggacttcgacgacgtggtcaaggtgctcgaggaggagggcgtcgagaagttcgagtcggcgtggaaggacctgctcgagggcgtcaccaagtcactgaaggcggcggccggcggcgcggagaacccgagcgacgcggcctgattgttgtcccggcgcggcctgtcgcggaacactccgcgacaggccgctcccttggcgaaaaactggcaggatggcaacgtgggtaatccgctgcgcaccgcacaggaccgacgccttccgcggattccggagccctgcgctctggtgatcttcggggtcaccggtgacctgtcccgtaagaagctcatcccggccgtgtacgacctggccaaccgaggcctgttgccccccggcttcgtggtggtgggcttcgcccgggccgactggggtgacggtgacttcgagtcgctggcctacgccgccgccaagaagggcgctcgcacgccctggcgggaggacgtctggcagcggctgtcgagccagttccagttcgtgcccggctcgttcgacgacgacgccgacttcgacaaactctccgagaccctggaccagctgcgcgagcgcaacggcatccagggcaacacggccttctacttctcgatcccgccggccgccttcccgctggtgctcaaccagctgaaccggaccggcctggcggacagcgcgaaactcggcggctggcgccgggtggtggtggagaagccgttcggcaacgacctgcagaccgcggtcgcgctgaacgcgctggtcgacgacgtgttcaaccccgccgacgtctaccggatcgaccactacctgggcaaggagacggtccagaacatcctggccctgcgcttcgccaacagcctgttcgagccggtgtggaattccaagtacgtcgactcggtgcagatcaccatggccgaggacgtcggcatcggcacccgggccgccttctacgacgcctccggcgccgcccgcgacgtgctgcagaaccacctgctgcagctgctcgcgctggtcggcatggaggagccgacgagcttcgacccgcaggaggtgcgggccgagaagctgaaggtgctcaaggcgatcagcctgccggccgacatcgcgtccggctcggtccgcggccaatacctgccgggctgggtcgccggcgagcgcgcggtgggctacctggaggagaagaacatcccggccgactcgacgaccgagacgtacgtcgcggtccggctcggcatccagaaccggcgctgggccggcgtgccgttctacgtccgggtcggcaagcggatgccgcggcgggtcaccgagatcgcgatcctgttcaagaaggcgccgcacctgccgttcgacccggccgacgtggagatgctgggcaacaaccagctggtcatccgggtccagccggacgagggcgtggtgctcaagttcggatcgaaggtgcccggcacggccatggaggtccgcgacatcgcgatggacttccagtacggcgaggcgttcaccgagtccagccccgaggcgtacgaacgcctggtcctcgacgtcctgatcggcgaccgcacgctgttcccggacgccgccgaggtggagcagtcctggcgggtcatcgacccgctggaggccgcctgggcgggtaccacgccggagccgtaccgcgccggcgagtggggtccgcgggcctccgacgagttgctggaacgcgaaggccgtgcctggaggcgagcatgatcgggctgtgggacaccaccggcaacgaggtggtcaaggcgctggccgcggagcggcgcagcgccggcggcgtggcctccgggctggcgctcacgctgatcgcggtggtcgaggagaagaaggtccgggaggccgaggcggccgccacgatagcggcggcggcccacccgtgccgggtgctgatcgtggtccgctccgacctggacggccgcagccggctggacgcggagatcgtggtcggcggccggctgggcccggccgaggcggtcgtgatgcggatgtacgggcggctcgcgctgcacgccgagtcggtggtcatcccgctgctcgcgccggacgtcccggtggtcacctggtggcacgaggagccgccggactcgatcgccaacgacttcctgggtgtcgtctcggaacgccggatcaccgacagcgcgcaggcgcccgacccggtggccgcgctgcgccagcgggcggccgactatgcccccggtgacaccgacctcacctggacccggatcacgctgtggcgcaccctggtggccggcgccttcgacaccaccgaggcccgggtgaccggcgcccggatcgtggccccggagaaggacccgaccgcgtggctgatgctcggctggctcaagtcccgactgggcatcgagccggtgctggagcacaccgaccgcgccccgcggatgcactcggtggagctgcagtgcgagaacggcgactgtgtccgggtcacccgcgaggagggcaccgcgctgttcagccgcaccggtcaggaggaccggtacatgccgctgccgaagcggccggtcggtgacgagctcgccgaggagctgcgccggctggacgcggaccagatctacgccgaggcgctgggggcgatggcggggctgtccgggctggacaaccggccggcggcccgggtgcacgtgtggaaggacccggcactggcggcgcgggcggccagcaccaccgacgcgatggccggctagcacatttttcgttcaggttgggccgtccgccaccggtgggcggcccttccggcaaaggagagcccctgtgagtgagaccttggtcgtggtggtcccggacgccgacatcctggcgtccacggtggcggcccggctggtcgtccggatcatcgacgcgcaggccgcccgcggctcggcgagcgtggtgctgaccggcggccgggtggccgccaaggtgctgcgccagctgggtgagctgccggccgccgcggcgatcgactggtcccgggtggacctgtggtggggcgacgagcgtttcctgccggccggcgacccggaccgcaacgagacccaggcgcgcgaggcggtcctggacgcgctgccgctcgacccggcccgggtgcacgccatgccggccaccgacggcccggacggcgacgacgcggacgcggccgccgcccggtacgcggccgaggtgaccgccgcgggcgcgcacttcgacgtgctgatgctgggcgtgggcgaggacggccacgtggcgtccctgttccccgggcacccggtgctggccgcccagggcgtggcggtcgccacgtacgacagcccgaagccgccgccgacccggatcaccctgaccctggacaccatccggcgggccggcgaggtgtggctggtggcggccggcccggacaaggcggaaccgatcggcgccgcactgcggggcgctgacctgccggccgcgcacgccgtcggcgtacaccggacgctgttccttcttgaccaggccgccgccgcgaagcgctaaggccgggtcgagatctgctggaccgcccagctgttgccgtccgggtcctcgaagaagaagaacccgacgttgtccagcggatgcggggtcgggccggggttctcccccagcgtcgtcacgtcgctgaccccgaccccgcgctcgaccagctcggcgtgcgccgcctcgatgtcgttgaccaccagttgcaggccgcgcagcgagccggccggcatctgcggcaccgcgcccttgccgatcacgatcgagcagccgctgcccggcggggtgatctgcacgatccgcacctggtcgcccatcacgatgtcgtggtcgacggtgaagccgagctgctcggcatagaacttcttcgcccggtcgatgtcggacaccggaacgacgaccacctcaagagtccagttcatggccaccatgctgccatccgtagactccggcaggtgtccgcaacgattcgcgcctaccgatcgagcgaccttgacgccatctacgacatctgtgtccgcaccggcgacgccgggcgggacgcccgcgggaagcacagctcggaccgcctgctcggggacatctgggccgcgccgtacgtgatcctggagccggagcacgcgcacgtgctggacgacgggaccggccgggcggtcggctacatcatcggcaccgcggacaccgagaagttcgtccgccgataccgcgacgagtggctgccggccaccgccgaccggctgaccggcggcgacccgcgcgacgagctgatgctgagcctgcaccggcgcccggagcggatgctgcacccggcgctcgccgcctaccccgcgcacctgcacatcgacctgctgccggaatggcagggccgggggcaggggcgcgggctgatggcggcgttcctggccgggctacgggcggccggagtgtcccgggtgcacctgggcatgtccccggagaaccagggggcgtacgcgttctatcaccggctgggtttccgcgacctgccggtcgacgacgacccgggcgcgctctatctgggccggaacacgggtccgctctagcggccgcggcgctggcgcagcttggcgagcgcctcctcgaggatggcggcgccgtcctcctccgagcggcgctccttcacataggccaggtgcgacttgtacggctcggtgcgggagcgccccggcggccgctcccggtccagtccggccggctgcccgcagcgggggcagtcccaggtgtccggggccggcgcctcggcggcgaaccagatgaggctgtcatggcccgcggcgcagaagtatttcacctgccggcgcggggcgggctcggtgcgctcgtcggggcgcatcgggctggagccgatgcggctgccacgaatggcgctgccactggacacggacgtcactcctgtcactgggggaaaccgtcggggacggtgcgaaaaaatgccgcacggccggagctaaccggccgcgcggcagattgtacgactctacttacgggtcaggaacccgtcttgctcttcagccagaaacccatgcccacgatgcacgcgaaccagaggacgccgaccaggaccgtgtagcggtccaggttcttctccgcgaccgaggagccggccaggctggaggtcacgccgccgccgaacatgctggacatgccgccgcccttgccgcggtgcagcaggatcagcagggtcagcagaatgctggtgatgatcagcaacacgatcaacgtgtacgcgaatccgatcggcatggtcgggttcattcctctcgaagggcacagcagcggtcccacaatagcgggtgcccggccgtttcccacggccgggcacgcgctccgcgcaatcagcgtgcgacgtgctccgggaatcgcacgatggaggcgaactcctcggcgtccaggctggcgccgccgaccagggcgccgtcgacgtccggctgcgccatgatctgggcgatgttcgcggccttgaccgatccgccgtactggatgcggaccgcctcggccacgtcggcgccgaacttctcggtcaggcgggcacggatcgctccgcacacctcctgcgcgtcgtccggcgtcgcggtcttgccggtgccgatcgcccagaccggctcgtacgcgatgacgatctgcttgatctggtcttccttgagcccgtccaggccggcgtcgacctgcgcggtgcagtgcgcgacgtggccggactcctcacggacggccaggccctcaccgacgcagaagatcggggtcaggccggccgcgaaggccgccttgatcttcgcgttgatcagctcgtcggactcctcgtggtactcccggcgctcggagtggccgatcaccacgtaggtgcagcccagcttcgccagcatcgagccggcgatctccccggtgtacgcgccggaagcgtgcttcgagatgtcctgggcgccgtaccggatcgtgagcttgtcgccctcgatcgcggtctgcacggtgcgcaggtcggtgaacggcggcagcacgaccgcctccaccctgtcgagctgctcgccggtcaggctcgccgccagcttctggaccagcagattcgcctcgtagtggttgaggttcatcttccagttgccggcgatgatcggcttgcgggtcacgtcacccatcacttctccagagcggcgacgcccggcagcgtcttgccttcgaggtactccagggacgcgcccccgccggtggagatgtggccgaacgcggtctcgtccaggcccagcgtgcggaccgcggcggccgagtcgccgccgccgacgaccgagaagccgtcgatcttggtgatcgcctcggcgacgccgcgggtgccggcggcgaacggggcgagctcgaagacgcccatcgggccgttccagaacacggtcttcgcaccggcgatcgccgacgcgaacagctccgtcgacttcgggccgatgtcgaggcccaggcggtcggccgggatcgcggacgccgcgaccacgtcgtgctgcgcgtccgcggagaactccgtggccgcgacgacgtcgacgggcaggacgatccggccctgcgcctgctccagcagatcggcgcagacggccaccatctcgtcctcgagcagtgacttcccgacctcgtggccctgggccttgaggaaggtgaagcacatcccgccaccgacgaggagcttgtccaccttcggcagcagcgcctggatcacggcgagcttgtcggagaccttcgagccgccgagcaccacgacgtacggcttctcgggggtctcggacaccttgcggaggacctcgacctccttgacgaccaggccacccgcgaagtgcggcaggcgggccgcgacgtcgtacaccgaggcgtgcttgcggtgcacggcgccgaaggcatcgtcgacgtagaagtcggcgaacgccgccagctggtcggcgaacgccccgcgaaccgcgtcgtccttcgcggtctcgccctcgttgaaccgcaggttctccaggagcagcacctggccgtcctgcagcgcctgcacggcagccgacgcggacgggccgacggtgtcctcggcgaagagcacgtccgaccccagcagctcacccagacgggcggcgaccggcgcgagcgtgtacttcgggtccggcgcgcccttcgggcggcccaggtgggacgccacgatcaccttggcgcccgcgtcacgcagggcgatcagcgtcggcagcaccgcgcgggcgcggccgtcgtcgctgatgacgcccgggttgctcttgtcgaagggcacgttcaggtcggcgcgcacgaagacgcgccgacccgagacaccctcgccgagcaggtcgtcgagagtcttcaagatcaggctccgacgagctggaccaggttgacgaggcggttcgagtagccccactcgttgtcgtaccagccgacgaccttgacctggttgccgccgatgaccttggtcaggccggcgtcgaagatgcaggaggccgggtcggtgacgatgtcggccgacacgatcgggtcctcggtgtagaccaggatgcccttgagcgcgccctcggcggcggccttgatcgcggcgttgacctcgtcgaccgtggtgtcccgggcggcggtgaaggtcaggtcggtggccgagccggtcgggatcggcacgcgcagcgcgaagccgtccagcttgcccttgagctcggggagcaccaggctgacggccttggcggcaccggtcgaggtgggcacgatgttcagcgcggcggcgcgggcgcgacgcaggtcgctgtgcgggccgtcctgcaggttctggtcctgggtgtacgcgtggatcgtggtcatcagacccttttcgatcccgatcgtgtcgttcaggaccttcgccatcggggcgaggcagttggtggtgcaggacgcgttcgagatgatcgtgtgcttggcggcgtcgtacaggccgtcgttgacacccatcacgatcgtgatgtcctcgttcttggccggagccgagatgatgaccttcttggcgcccttgtcgatgtgcgccttggccttggtggcgtcggtgaagaagccggtcgactcgatcacgacgtcggcacccaggtcgccccacggcaggttgttcgggtcgcgctcggcgaacgccttgaaggtgttgccaccgacggtgatctcgtcggcggtggccttcacctcgtgcggcagacggcccaggatgctgtcgtacttgagcaggtgcgccagcgtggcgttgtcggtcaggtcgttcacgccgacgatctggatgtcggccccggaggcgagcgccgcccggaagaagttacgaccgatgcggccgaagccgttgatgccaacccggatggtcacaggtggtctcctcatttcggtccgccggattctgcgaccggcggagagtctcgtgccgaccgttttgaggggcccgcacagggcgtccagccgccgcgcccgaagaagcgagaacgccacagcagagccactttggcgaagtcacagcgggggttcggccggactgccggcaccgtcgccgtcaccagtgaccctagccgagccccccggcaccgaacgcagcggggcgcgacctgaacgttatctaaatccgaactcgcggcgccccgccccgcgcccggatcaccgcgtccaccccggcatcaaggacacgacggcggcggtacgccggtgggcgccccgccgcgcgacgacggaggtgatcgagatcacccggctagcaggccatcatctcgggggtgaccgccgcctccgtgtcggggatgccgagatcccgggcccgcttgtcggccagcgcgagcaggcggcggatccggccggcgatcgcgtccttggtcagcggcgggtcggccaacgcgcccagctcctccagcgaggcctgccggtgctccagccgcagccggccggccgaggtcaggtggttgggcgcgtcctcggccaggatctccagcgcgcgggtgacccgggcggcggcggccacggcggcgcgggccgaccggcgcaggttcgcgtcgtcgaagttggccagccggttcgcggtggcccgcacctcacggcgtaccctccgctcctcccaggccaggacgctggagtgcgcgccgatccgggtgagcagagcggcgatcgcgtcgccgtccttgatcaccacccggtcgacaccgcggacctcgcgctccttggcggtgatcccgatccggcgggccgcgccgcgcagcgcgagcgccgcctccgggcccgggcaggtgatctccagcgcgctggaccggcccggctcggtgagcgagccgtgcgccatgaaggcaccccgccaggcggccaccgcgcagcagacgttcgccgagaccacgtgcgggggcaggccgcggaccggccggccacgcacgtcgagcaggccggtctgccgggccagagcctcgccgtccttgacgatccggacgatgtagtggctgcccttgcgcaggccgccggaggccagcacgtgcacctcgctggggtagccgtacacgtcggcgatctcccggcgcagccgccgggccaccgcgccggtgtccagctccgcctcgacgaccacccggccggagacgatgtgcagcccgccggcgaaccggagcagggacgccatctccgcccggcgacagcagggcttgggcacgtcgacccggctcagctcgtccttgaccgctgccgtcatcgccatcgtgttgtcacctcatgcgccggatcttggacagtgtgtgccgcacttacgccagtgattaacgagcggcgcccaatactggcaccagtgcaacacccagtgcctcaggatcatgccgtgggctcccgtccgcaacggcgacgggtgccaataccagatcggcgcccatctcccgggcggcgacacgtaccggttcgggttcgcctgcccatttcacgtcggccagcacggtgtccacccgcaactccggcaggcaccggtgcaacgtggtgaggtgcccggcggcggacaggccgtgggtctccttgtcggtgcccaggttcagggtgaccagccggcgggccgggctcgccacgatcgcccgggccaggcccggcaccagcaggtgcggcagcacgctggtgtaccagctgcccggcccgaagatcagccagtccgccgccagcaccgccgccaccgcctgcgggcaggccggcgggtcggccggctccagccgcacgccggtgacccggccgccggacaccgcgaccgaatgctggccgcggatagtgaccgtctcgtccggccgggccgggtcggcgccgatcacgtccgcctcgataccgaccgcgtgcagggccatcggcagcacccggccgtgcgcgccgaccatggcggccgcgtggtcgagcgcccggaccgggtcgccgagcagctccatcaggccgagcagcagcaggttgccgacggtgtgcccggccagggtgtccttgctgcggtcggcgcggcgctccagccgcggcccgcgcaccaccgggggcagcgcctcgacggccgcccgcgacgggccggcgtcgttcctgacgcccgtcgccgccgccggctcgggcatcgccgcgaaccggtgctgcatcagtgtcgcggtcagctgcgacgtcgggtgcccgtcggccagcgccgccagggcctggcgcaggtcgcccgggggcagcagggcgtcccgttcgacccgcaggcggccgctggagccgccgtcgtcgccgaccgtcacgatcgcggtgatgtccaggggcagctcggccgcggtgtgccggagcgcgcgcagcgaggcgcccagcccgtgcccgccgccgaacgccaccacccggaccggccgggccgtcactcgcgccccaggtcgcggtgcgaggcgtgggccgagaggcgcatggcactgagccgcgaagtcaactcctcggttatcgccacgctccggtgttttccaccggtgcacccgatcgcgaccgtcagatagcgcttgccctcgcgctcgaagccgggcgcggtggccgcgatcagccccgcgtaggtggcgacgaagtcggtggcgccctcctggcccagcacgtagctgctgacgccctcctccaggccggtgtgctcgcgcagctcggggacccagaacgggttgggcaggaagcgggcgtccagcacgtagtcggcgtccggcggcaggccgtacttgaacccgaaggagagaacggtgatccgcagcttgcgggcgtcctccccgccgaacagctcctcgacccggcggcggagctggttgacgttcaggtggctggtgtcgatgatcacatcggcctgctcacgggcctcggcgagcagcttgcgctcggcggcgatcccgtcggccagccggccgtcgccctgcagcgggtgcgagcggcggaccgactcgaaacgccggatcagcacctcgtcgtcggcgtcgacgaagaccacccgcggggagaagccgcgctccttgagggcgcgcaccgccccggccaggtcggtggagaaggcgcggctgcgcacgtccagcaccatcgcggtgcgccgggcggcgccgccggccgcgaaggccagctcggccatctccagcatcagcgcctggggcaggttgtcgaccacatagaacccgacgttctccagggcccgggccaccgtgctgcgcccaccgccggacagcccggtgaccaccaccaggtcggtgcccgcctcgtccgggtcgaccacgccgtcggctccgaacccgggcatcgcttccgtcacgcacgcctcccgcgtcgctcggcccgcacctcaccagcgggccttgtcgtccgtttcgtcggggggcttccctcccgagcggacacaacatcgtagtccgatgggtaccggtccagccgccggacaggttgtccggcggaggccctcacccgccgccgggcccgttcagcgcggccagcaccgcctcggcggtccgccggcccacccccggcacctcgatgatctcctccggggtcgccgcggcgagccgcttcaccgaaccgaagtgccgcagcagcgccttgcgccgggtctcgcccagcccggccacgctgtccagcgccgactcggtcatccgcttggaacgccgctgccggtggaaggtgatggcgaaccggtgcgcctcgtcgcgcacccgctgcagcaggtagagcccctcggaggtgcgcggcaggatgaccgggtagtcgtcgcccggcagccacacctcctccagccgcttggccagcccgcacagtgccacgtcggtgatgcccaggtcggccaggaccgcggcggccgcgttcacctgcggctggccgccgtcgaccacgaccagctgcggggggtaggcgaaccggcgcggcttgccggtgagcgggtcgatccccggcaggtcggcggtctccagctcgccggtcgcctcgccgagctcctcggccggcggctccggctcgtcgcgcggcgcgtccgccccgggctgcgcccggtatcgcgcgaaccggcggcgcatcacctcgctcatcgcggacaggtcgtccatcccgctgccgtcggcgttgccgcggatcgcgaagcgccgatactccgacttgcgggccaggccgtcctcgaagacgaccatcgaggcgaccacgtcggtgccctggttctgcgagacgtcgtagcactcgacgcgcagcggcgccgactccagtccgagcgcctcggcgatctcctccagggccttgttgcgggtggtcaggtcgccggcccggcgcagcttgtggcgctgcaacacctcgccggcgttgcgcgccacggtggccatcaggtcgaccttgtcgccgcgctgcggcacccgcaggctgacccggctgccgcggcgcgccgacagccagtcggcgagcgcctcggcgtcctcgggcagggccgggaccagcagctcccgcgggacgtcggtctcgccggccgactcaccgtacatctgggtgcagaagtggtggaccaggtcgccggtggacagatcctccaccttctccaccacccagccgcgctggccgcggatccggccgtcgcgcacgtggaagacctggacggccgcctccagcgggtcctcggcgaaggccaccacgtcggcgtcggtgccgtcgccgagcaccacggtctgtttctccatggcccggcgcagcgccgcgatgtcgtcgcgcagccgggcggcccgctcgaactccagctcctcggaggcggccatcatgtcgcgctccagccgcttgacgaaggcgtcggtgcggccggccatgaagtcgcagaagtcgtcgacgatgacccggtgctcggccgcggtgacctggccggtgcacggggccgaacatttgccgatgtagccgagcaggcaggggcggccgatctgaccggcccgtttgaagaccccggccgagcaggtgcgtgccgggaagacgcggagcaacaggtcgagggtctcgcggatggcccaggcgtgcgaatagggcccgaagtagcggacccctttgcgcttggcgccgcgcatcacctgcagccgggggaactcctcgttgagcgtgacggcgaggaacgggtacgacttgtcgtcgcgatacttcacgttgaagcgggggtcgaactccttgatccaggagaactccagctgcagcgcctcgacctcggtgccgacggtgacccagtcgaccgcgccggcggtggtcaccatctgctgggtgcgcgggtgcagcgaccagacgtcggcgaagtaggaattcagccggttgcgcaggctcttcgccttgccgacgtagatcacccggccggacggatcgcggaagcggtagacgcccggagcgtcgggaatggtaccgggcgccggacgataagtggacgggtctggcacaaccacaacagtagtgcctgggactgacatgattgcccgaccggaggtccggtgccgccgccacggcgccggatctccggcctgtgcccgcaatcgggcgccgcggcccgtgcctgggtcgggccgcgacgcccgacgttcggctcaggccgcgacgatcttgtcgccgtccaccttgaccttcgtctcggccagcggcttcggcgccgggccaccggccaccgagccgtcctcgatggagaacttcgcgccgtggcacgggcagttgatcgtgccgttcttcacctcgctgacctcgcagccctggtgggtgcagatcttggtgaacgccttgaaggtgccctgcttgggctgcgtgatgacgtagtcgccctggatgatgccgccacccgagggcacgtcggccaccagcgcgagctccgccccggccgccgagccgccccccttcgacccgccggtgctgccgccgccggtcgcgccctagctagctaggccggccggcgccggctcggcggcgaagtcgctgccgttcgggttcgtcgtggtggtgctggtgccacaggcgctcaggacggcggccgcgccgaggccgccggcgcccagcagaacgacgcggcgcgtcgatgcggggcccgccggctccgcctgggtgtcgacgccggtcccggtctgcacgtcagtcatgtatcgcccctccagtacctggtccgcgcccgatgtcacgcggagtcatccctgagtacgcggccgccaccgcgatcggttcatgcgtccggcgagattaaccgccgaagattgcggcgtctttccccgtttcgtacgcataccgtcagcccgttcgcccgaggcgaccgacgaccgccgatgccacgaccctatgagccgcagcatccgggacagctgtgcgtcatctaagaaacttctaaaatcaactttcccgcagtggcgcattccggggtcgcgcgcgcccgtgcggtgccccggctgccgcccggacggcgaaccctacggcgatgtcccgctgatcctggatcagctccgcacgaacgccggaccaaccggctcgccgttcggttctcccggactcagccttacggggacaccgagcaggcgcgacggccggggcccagagccacgaccgccgcgcgtcggcgtaccgccgatcggcttctcagacggccgccttggcccgcgaccgcgtcgcccgcgccttcgccgcgggggccttctcgccgttggccttggccgcgcgggcgaccgcggccggtgacccggcgccggagcccgacagccccagtgtgtgccgcaggaactgcccggtgtgactgtccggcacctcggcgagctcctccggggtgccggtggccagcaccaggccgcccttgctgccgccctccggacccatgtcgatcagccagtccgcggtcttgatcacgtcgaggttgtgctcgatggtgatcaccgtgttgcccttgtcgaccaggccgttgaggacgatcagcagtttgcggatgtcctcgaagtgcaggccggtggtcggctcgtcgagcacgtagacggtccgtccggtggagcgtttctgcagctcggaggcgagcttgacgcgctgggcctcgccgccggagagggtggtggcgggctggcccagccggacgtagccgaggccgacgtcgaccagggtgcgcaggtgccggtggatggccggcagcgccgagaagaactcggccgcctcctcgatcggcatctggagcacctcggagatcgtcttgcccttgtagtggacctccagggtctcccggttgtaccgcgcgcccttgcacacctcgcaggggacgtagacgtcgggcaggaagttcatctcgatcttgatggtgccgtcgccggagcagttctcgcagcgaccgcccttgacgttgaacgagaaccggcccgggccgtagccgcgcaccttggcctcggcggtctcggcgaacagcttgcggacgtggtcgaagacgccggtgtaggtggccgggttggaccgcggggtgcggccgatcggcgactggtcgacgccgaccaccttgtcgacgtgctccagcccggtgaccttgatgtgccggccgggcacctgccgggcgccgttgatctgattcgccatcacggtgtgcaggatgtcgttgaccagggtcgacttgccggagccgctgaccccggtgaccgcgatgaactggccgagcgggaacgggaccgtcaggttgcgcaggttgtgttcgcgggcgccgtgcaccaccacctcgcgcccggcggtctgcgggcgccgggtggccggcagcgggatcgacctacggccggagagataggcgccggtcggcgacttctcgttcgcgagcagaccctcgacggtgccgctgtgcacgatgtggccgccgtgctcgccggcgcccgggccgatgtcgacgatccagtcggcggtccggatggtgtcctcgtcgtgctccaccacgatcagcgtgttgcccaggtcgcgcagccggaccagggtctcgatcagccggtggttgtcccgctggtgcaggccgatggacggctcgtccagcacgtagagcacaccgaccagcccggagccgatctgggtggcgagccggatgcgctgcgcctcaccgccggagagggtgccggcgccgcggtccagcgacaggtattccaggccgacgtcgaccaggaagcgcagccgggcgttgatctccttgagcacccgctcggcgatcatcttctgccggtcgtcgagctccagcccggcgagcagctcggcgcagtcgccgatggacaggttgcagacctcggcgatgctccgcccggccacggtgaccgcgagcacctcgggcttgagccgggcgccgccgcagaccgagcagggcacgtcgcgcatgtacccctcgtacttgtcgcgggaccaatcgctctcggtgtcgttgtgccggcgctcgatccactgcacgacgccctcgaagccggtgtagtaggaccgctcgcggccgtacttgttccggtagcgcacgtggacctggtcctcggagccgtgcaggatcgtcttctgtgcgcgggccggcagcgcccgccacggcgtgtcgagcttgaagccctcggccttggccagcgcctccagcagacgcaggaagtactcctgggtggtgccgccggcccacggctggatcgccccctcggcgaggctcttctcctcgtccgggatgatcagctcggggtcgacctccttcttcgtcccgaggccggagcactcggggcaggcgccgtagggcgcgttgaaggagaacacccggggctccaggtcctcgatcgccagcgggtgatcgttgggacaggccaggtgctcggagaagcggcgctcgcgctccgggtcgtcctcggcgaggtcgacgaagtcgagcaggacgatgccgttggccaggccgagcgccgactcgaccgagtcggtcagacgctgcttgctggacgccttgacgctgagccggtcgaccaccacctcgatggtgtgcttctcctgcttcttcagcttcggcggctcggtgagctggtgcaccacgccgtcgacccgggcccgggcgtagcccttggcctgcagctcggcgaacaggtcgacatattcccccttgcggccgcggacgaccggggcgagcaccatgaaccgggtgccctcgggcatcgccaggacccggtcgacgatctgctgcggcgtctgcctgctgatccgctcaccgcagaccgggcagtgcgggatgccggtgcgggcgaacagcagccgcaggtagtcgtacacctcggtgatggtgccgacggtggagcgggggttgcgcgaggtcgatttctggtcgatcgagacggccggtgagaggccctcgatgaagtcgacgtcgggcttgtccatctggccgaggaactgccgcgcatacgacgacagcgactccacgtaccgtcgctgcccctcggcgaagatggtgtcgaacgcgaggctggacttgcccgaaccggagagcccggtgaagacgatcatggcgtcgcggggcaggtccaggttgacgtcgcgcaggttgtgctcgcgagcgccacgaatagtcagtcggtcggccactactagcctctccgtacaggtgtttgaaagcagacaggccactctaacgacggggtatgacaaaaaccgtcgacctaggtgcagcgcctctcacatggcggacattcccgcggagcggacccgggaacgtcactcctgcgggtgagccgggacggtccagatctccacgccgccgacgggctgcggcggccggcccagcgcgtcgaccagggtggcccgcagcacgtccacgttcttggcctgtgggaccagcaccaccaccgccgcccgccagtaggccaggtcagccgcgatccgctcccggtcggcgccggtcagcaccggccggcgcccggtcagctgcgcctggacgaggatcgtgttcgtgaaggtggccggggcgcgccaggacccggtggtgtccgacggggggttgaccgggcccatgaagtagccgcccggcacggcgaagtccaggttctccagggtggcccagcgctgcccggtccggccgtaggtgacctccggcagcggcaccggcaccagggtccggcccgccggcacgtactgcttccagatgccggcggtcaggaacggcggcagcgggtcgcccgcgaccaccggcagcggcttcgggatcagcgggaccagcgccagtgtcaggccgatccagaaccggcggcggtgcaccggggtgagctcgcccacccggtcgacggcgagggccagcaggatcccggcgatcgtcgcgggcaccatcgcgaaccggctcacgctcaccaggtcgatcaccgggaggtgactgatcagggcgaacggcatcgggatccaggtgcggaagccggccacctgcagcctcggcccgaacgacatgaccagcagcaccagcccggcgatcgccgccgaccgggccgccgccgaccgccacagcatccgcatcgccacgatgatcatgacgaggccgaacggtccgaagaacgtgttgtcctcggtcgggctcaggctcagccgccgggccaccggcccgatcccggccaccgcctgccgcgggtacgccccgatcgacagcaggtcggtgacgatcttgtcgggctcgaacggctgaccgtggtagttgccggcggcgaagaactggtaccacaacggatacgcgcagagggccgacgcggtcccggcggcgaccgcgagcccggccacgaaccgcccggccaccgcccgcgcctcgtcgcgccgcagcagcgaccaggacaccacgaagacgcccagggtcagcgcggtgaagagcagtgtctcctcgttgatgaagatctgcaggaccagcagcagcccgaggatcagcccgccgcggaccgcccggcccggctcccgcagccgcagcacctgccagacgatgaacggcaccagatactggttgacgaagttcacgtggccgctggcgtgcgagatcatcgccggcgcgaacccgcaccagaacgccccgagcaccgcggcccgccggctggtcaccaggtgccgggcgaacagccagtaccacgcggcggcggtgccgaacaggccgaaggtgatcaggaagaccaccgagaagccgccgcccaggaagtgcgtgaccggggcgagcggcaggctcagcgcgaggatcgccgtgttggccatcatgttcacgccgaccggcgcgttgaggtggctctcgaagaacagcggcgcgccgtggaacaccacccgctcgccgtgggccagcatgaataggaagatcccgtggtcgtcccggttgccggcgagcacccgcccgttcggatcgatccacagctggatcatcaccagcccggccagcgccaggaagctcagcaggacccagagatcggtccgccgccagccgccgaagccgctccgcgcctccgtgacgaccgtctcgtcccgtttccccgccacttcctccaccgcacgcaccggccggattctgccagaggggtgcgacaagcccgtccctaggtgttggcgaaccggttcatcaccccggcgtcaccggtcccgccgccgcggcgcggtcgccagccgcaccgtgcgccgccggctctgcaccaccacctcccggtgcagcttgcgccagctggccagccgccgcggcggcagcgacccgtcgccgagcgccgcctgcaccgcgcaccccggctcggactcgtgcccgcagtcgtcgaaccggcagtgtccggccagctcggtcacgtcggcgaacgcccgctccagcccggagccggtgtcgagcaggccgacgccacggatccccggagtgtcgatcacgccacccccgcccgggatggtgaccaggctccggtacgccgtggtgtgccgccccttgccgtcggcgtcccggatcgcctgcaccggcatcaccgacgccccggccagcgcgttggccagcgtcgacttgccggccccggaccggccgagcagggccagcgtgcggcccgggccggccagctcgcgcaacggttccagcccggtcccgcgctgcacgctcaccggcagcaccgggacgccgggggccagctcgccgagctgccgggccaccgcccgcggatcacgggtggtgtcgctcttggtcagcaccagcaccgggtcggcgccggactcccaggccagggcgagcagccgctccacccgggcgtcgccgggctcggggaagatcggctcgaccaccgccaccgtgtccatgttggcggccagcacctggccggacgagtccttgtcggcggtgcggcggatcagcgtggtgcgccggggcagcaccagctccagcgtgacccggcggtcgggccagtcgcgcagcaccacccagtcgccggaacacggcagccgggacgggtcgcgcgcggcgtcgagcagcgcgttgccgcccagcgaggcccgggtcacaccgttcgcggtgagcacggtgctgacgccccggtcggcgcgcagcacccggccggggcggctgtcggcccggtcgtagggacggaacgcggagacgaagagctcgtcccagccgagctgggacaggtcatacgacatggtgaaccctttacggtcgtgagggggcggaggcccccgggtgaagggacgcggcaaccacgatcagcacgtgcctcacctcctccgcgggttcgatcaagtggcgcgtcttgtggatcgacggtacgaccgtccggagtccgcgggaaagtgaattccgcggctaggctcgtgccgtgacgatcgatccgctggtcctgatgaccgacgtggaccaagccaccgacaacctgctgcgcgccgccggggagctggacgactcggcgatcggcgagccctccgcgctgcccgggtggacggtgggccatgtgctcacccacctggcccgcaacgccgaggctctgaccaacctgctgacctgggcacggaccggggtggagaccccggcgtacgcgtcccgcgaggcccgcgacgccgccatcgaggccggtgccgggcggccgctggccgaccagctcgccgacatccgcaccgcgcacgagcggttcgccgacgccgcggccgcgatgcccgccgaggcgtggacgttccgctacccctcgttgatgccgtccgcggccgtggtgccgtgggcgcgcctgcgcgaggtcgaggtgcaccacgtggacctgggccgcggctacacgccggccgactggtccgacgcgttcgcactgcggctgctccgcgagatcgcgggcgacctgccggagtccgcgccgcccatggtgctgcacccggccggcgtcgaccacccgctgctgatcggctccggtgacggcccggcgatcggcggcccgacccggtcgatcgcggcgtggctggccggccgcgccgacggcgccgacctgaccgtctccccggacggggagctcccgcaaccagcgaggtggaagtgacgtacgacggcaccgctcccggcacccgcgacctgggcggcggtctcacgctgcgcaaggtctcggtcggcccgatggacaacaacgcgtacctgttgagcgccggcggcgagcagctgctgatcgacgccgcgaacgacgccgccaccctgctcgacctcgccggtccggccgggctggccaccgtggtgaccacccaccagcatcaggaccactggttcgcgctggacgaggtggtcaaggcgaccggcgcggcgtcgctggcgcacgaggcggacgccggcccgctgccggtggtcacccgcaccctgcgcgacggcgatacggtgacggtcggtggccacgagctcgaggtgatccacgtggtggggcacacgcccggctcgatcgtgctggcccttccggagccgggcggcggccgggtgcacctgttcaccggcgacagcctgttccccggcggggtcggcaacacccgcggggtgaaggagaatttcgcgtcgctgatcgaggacgtcgagcgcaggctgttcgaccggttcccggacgacacctggttctatccgggccacggcaaggactcgacgctcggcgccgagcgcccgcacctgcccgagtggcgccggcgcggttggtgaaaccccgggtcccgggcaattggcgtgcccgggacccggctcaccaggtcagccccggccctgcttggcgttcgggttgacgtggatcccggcggtgaaggcgacgatctggtcgcggctccagtggatgccgtcccagacctggacctccaggttgatcccgttcggctgcttgacgaacagggtgatgccgtcaccggcgtcggaccgcttggcgaagaagccctcccggccgccgacgctcaccttctccggcttgcccggcatcgcgccgtgctcgtcgaccgactgcagcatcacggcgaccttgccgacgtagctgttcgggtcggagtcggcgacgtcaccctgcggcacggcgctgttgtgcggcttggcgccgaccggggccagggtcagcgaggactcggtgacgccctgcacctcccaaccggccggcaccctgtccaccgagaaaccggcaggctgcttgccggtgtaggacaccaggtcgaacgccgcggtaccggccggcgcgctggtcgcggccgccgtggtgccgccggccaggggggtgccggcaccggacggcccgccggctgagccgaagccgacggccgcggcggcgaccgcgacgacgagggcggagccggccgcggactgcaggatccggcggcggcgcagcgcggcgcggccccgggccaggtcggcctcggcctggacggtggtgggtgcgcccggcgacccggcgaggtcggcgagctggtcacgcaaagtggtcatgagatgtgccttctcagcgttgaacggtggtcagggacgggccgatgacggcccggagccggtcgagggcccgggcggtctggctcttcaccgtgccctcggaacagccgagggcgtcggcggtggcagcgacgtcgaggtcgtagaaataacggaagaccagggccgcccgcatccgcggaggcagctgccgcagggccgcgcgcagcccgtcggtcgtctccccggtcccgcccgggtcagccgcgggcacgtccggcacgtctgccatcgactcctcccgccgccgccaccagcgccgccgttcgtcggtcaacgcgttgaccagcacccggcgcagatatccgtccgggttgtcggcccgctggaacgccggccacgccacgtacaacttggtcagcaccgactggaccaggtcctcggccaggtgcgcgtcccccgcggtgagcagagtggcggtccgcaccaggccggatctccgggacaccacgaagcggtggaactgttcgtcgcgctcgcttctcacgagtcctccttcgctgtcacacctccctgacggtcccggccacccccgggttgcacgcccggcggaaacaggcggcgaactcgtcgccgtcgccgtccggggaccggcccgctccaccggagaagcgacgcgacccgtgacccggcacagtggacgatgtgagatccgtctccgccgcgaaaaggcggctctgctgcggcagccggaacgtggacgcgtgccggcggtgagcaccgccggcgccgctgccgactccggcggcttccggtgatccacgggtaacgcgcgtacgctggcgtcagggtccgtcctgtcgatcacgcgggaccagggaggcgtcgatgaatctcagacacgacccgtcgcggtggggcgtgccccagcagcagcccccggtgccggctcccgggccgctcttccccggctggctcgaggagcgcctgttcgaccagcggatcgtgatgctccgcgggcatctcagcagcgaggcgtcgaccagcatctcggcggcgctgctcaccctggacgcggccggccaggcgccgatccagctgcacgtggcctgtccgggcggcgatctgagcgcggcgctcgccgtggtcgacgtgatcgacgcgctggtgtcgccggtgcacgcgctggtcaccgcggaggccggtggggcggccctggccgtgctgaccgcggccgaccgacgggccggctatcggcacgcccggttcaaactcagcgagccccgggcggccggggtcaccggaacggctgacgaggtggccgcggcggccgggcagcacctgcgcgaactggaggaggtcgtggtccgcctcgccgagctgaccgggaaaccgcgcagccggatcgaggacgacctgtccggcggccggagtctgagcgccaccgaggccctcgactacggcctgctcgacgaggtcatcacgccgaaggcccgctgagcgccaccaccgccaccgcgcccactcccccgcgccgcgcgcccttgaccgagccgccacccgccgcaaccgggacagggcgccgcccgcggtaaccgggacaggccaccgcccggccgcaaccgggacagggcctagctagctagaccgcccgcggtaacggaaacggccccgggcgcatgcccggggccgttccgtcagaactgcgggatcaagaggcgaccttgacgcccatcgaacgcgcggtgccggccacgatcttgatggcggcgtccaggtcgttcgcgttcaggtcggggagcttgcgctccgcgatctcgcggacctgggtggcactgagggtgccgacgttctgggtgagcgggttcgacgcgccggactggatacccagcgtcttccggatgaggaagctggtcggcggcgtcttgtaggccagcgtgtggctgcggtcctcgtagaccgacacgatgaccgggatgatctcgccccggttcttcgcggtggcctcgtcgtactcgaccttgacggcacgcatgttggcaccggtcgggccgagcatcttaccgaggtcgaccatcgcggcgttacccgcctcaagcgcgagggttacctcatgggtcttcttcttgggaggcatcgggtaaggctccttagggtgagctgcgggccgagacaacgcagctcgccagcatcaacgacacacgacaaccccgagaccttactaccgctgtgacgagagggtcaaaacggctggtaagcggggtctcgggtccgccgaccagtgtagctcgcggtcccggggactccgggaccaccccggatcagtacttgtcgcagaagcagtcggccatcagcgaccgcaccgagtcgacgtacgccggattgggaagtttcttggtcttgaggttctgcagcacggcgtccgggcccgcctggtaggccgcgatggtgatgttgagcaggcaccacgagctgtgcgtccggcacttgccggggctcaggtcgaagaccttgtcctggtcgaaggccttctgcgacatgtaccgggtcagccaggcgagatagttggcgcccgcggtggcgttctcctggtagttcgacacgttgtagctcaccccgaaccggccgttgatcatgttgaccgtgtccggcatcagctgcatcaggccctgcccgccgtcacagttgaagacgttggtctgccagccgctctcgtgccaggcgatcgccttgaccagcgggtagttcagcttcagctggggcgcctcgtgcgtccagtaggtcttgccggccgccgtcttcagcgccgccttcaccttggtcttggcgaccgcggtgcccttcttggtggagcaggcggacacctcgaagttgttcacgtcctccggcggggtggccgccctggtggtcggcttcctcgtcggggtggccgtcggcggggtcggcgagggggtggtttccgccggctccggactgctctgctcgggcgccggcgagtcggacggcaccgactgcgccaccggcgcgctgcccgccgacttctggtcgtccccaccaccgaacaggccgcagcccgccgtcatcgccagcatcgccaccacggcgaacaagcgcaccttcatcgacgtagtcctccccgtaggtatatcgatgaagacgctaacagtggcgatctctttgcatggggcgcgggaatatctcaaaaaattttcccgacccccagacatgaccccgtgtcacgatcggcaacctggaccggggacaatgggtgccatgcagacccgcaccgacctccgtaatgtcgccatcatcgctcacgtcgaccatggcaaaaccaccctggtcgacgccatgctccgacagggcggtcagtcccacgcacgtggagagatggccgaacgcgccatggactccatggacctggagcgggaaaagggcatcaccattctcgccaagaacaccgcgatcagttaccagccggccgagggcgacccggtcgtcatcaacatcatcgacactccgggccacgccgacttcggtggcgaggtggagcgcggcctgaccatggtcgacggcgtggtgctgctggtcgacgcgtccgagggcccgctgccgcagacccgcttcgtgctccgcaaggcgctctccgccaaactgccgatcatcctggtgatcaacaaggtggaccggccggacgcccggatcaaggaggtcgtcgacgacacgtacgccctcttcttcgacctggacgccgacgaggaccagatcgagttcccgatcgtctacgcctgcgcgcgcgacggcatcgcctcgctgaaccagccggccgacggcgccgtcccgagcgacagcgccgatctggagccgctgttcagcacgatcctgaacaccatcccggcgcccacctacaccgagggcgccccgctgcaggcgcacgtggtcaacctggacgcgtcgccgttcctgggccgtctcgcgctctgccgcgtgcaccagggcaccatccgcaagggtcagaccgtcgcctggtgcaagaccgacggcacgatcgccaacgtccggatctccgagctgctgatcaccgagggcctggagcgcaagccggccgagagcgccggtccgggcgacatcatggccgtcgccggcatcccggagatcatgatcggcgagaccctggccgacgcggagaacccgatcccgctgcccctgatcacggtcgacgagccggccatctcgatggtcatcggcaccaacacctcgccgctggtcggcaaggtcaagggcgccaaggtcaccgcccgcatggtgaaggaccggctggacaaggaactgatcggcaacgtctcgctgcgcgtcctgccgaccgagcgtccggacgcgtgggaggtgcagggccgtggcgagctcgccctggccatcctggtcgagcagatgcgtcgcgagtcgtacgagctgaccgtcggcaagccgcaggtggtcaccaaggtcatcgacggcaaggtgcacgagccggtcgagcgtctgaccatcgacgcccccgacgagtacatgggcgccatcaccaccctgctcgccacccgcaagggccggatggagcacctgaccaaccacggcaccggctggctccggatggagtggctggtcccggcgcgcggcctgatcggcttccgcaccgagttcctcaccgagacccgcggcaccggcatcatgcaccacctgtacgaggaccacgagccgtggttcggcgacctccgcacccggcagaacgggtcgctggtggccgaccgggccggcgcggtcaccccgttcgcgatgatcaacatccaggagcgcggtcagctcttcgtcgagcccaccaccgaggtctacgagggcatgatcgtgggtgagaactcccgtgaggacgacatggacgtcaacatcaccaaggagaagaagctcaccaacatgcgcgccgccagcgcggacaacaccgagaaggtgatcccgccgcgcaggctgtcgctggagcagtcgctcgagttctgccgcgaggacgagtgcgtggaggtcaccccgaacgcgatccggatccgcaaggtcgtcctggaccagacggcccgtgcccgcaccgccgcccggcgcaagcaccagtaacccgcgcttccccccggaacgccctcgccgatcggcgggggcgttccgcttttccacaccgggccgaccgttccggggtggcgcgacgccgcgccgtccgttccggggtggcgcgacgccgggccgaccgttccggggtggcgcgacgccgcgccgtccgttccggggtggcgcgacgccaggccgaccgttccggggtggcgcgacgccaggccgaccgttccgggcgggacgacgccgcgccgaccgttccgtggcgcggccggaaaacttcggaagtcgaaccggatgccacgagcccgggcgaacgggtcgcccgggctcgagtgcggatcgtggttcagcgcccggcggtgatcaggtcacttttccggtctcgcgccgatttggccaggctggcgacggtggcggcgcccagcgtgccgaggatcaccagcagggacagccagatcgggatttccggcgcccagtgcaggccgtcgccgccgttgatgaacgacaggctgttggtgtgcagggcttcgaggaacagtttgacgccgatgaacgcgagcaccacggccaggccgacgttcaggtagaccaggcgttccagcaatccaccgagcaggaagaacaactgccgcagacccatcagcgcgaagacgttcgcggtgaagaccaggtacggctccttggtgatgccgaagatggccggaatcgagtcgagcgcgaagatcaggtcggtggtgccgatcgcgatcatcacgatcagcatcggcgtgaacaggcgtttgccggccgcggtgaccacccggaactgcccgtcgccgaaggacgaggagagcggcagcgcccgcttcgcccagcggatcagcaggttctccttgaattcgtcctcgtcgccctcgccgcccttgaccagggtcacggcggtgtacaccaggaacgcaccgaagatgtagaacacccaggagaactgcgagatcagcgcggccccggcggcgatgaacgcgccccgcatgaccagtgccagaacgatgccgatcagcagcaccttctgctggaagcggcgcgggaccgcgaaccggcccatgatgatgacgaagacgaagagattgtcgacgctcaatgagtattcggtgagccagccggtgtagaactcgcccgcggcccgccccccggagaccgcccacacacccaccccgaagagcagcgcgaaggcgacatagaaggcgacccagccaccggcctctttcatggtcggctcatgtggccggcgcccgatgatcagaagatcgacggctagcacggccaccaacgccaccagggtggcgaaccagatccaggctgaaacgttcaagacgaacctccggcagacacgaggcgccgctgtccgattgtcgagatcatcgacctcaggaacggacagtgacgtgcggctgtcggaggtctcttccgccgcggaacttcgccgcgacccccggccccgggttcacccgctggtcacccgagcgagcgttccgtgttgacgagaccggggcgggggaatactcccctcccacactgccattgttgcgcatccgacccccgatcgacacctcgggagccgaagagtgggccgactcgctttccaaaccacccggcccgccgattaccacccggtaacccccgagccgggtcaccttcacttacacaacagggcgatcaaggccctcagcagtcacttcgctcgcgccgttcactttccgtccactacccgccactccgcgccgaccgccgtgacgcaacgaccgaacccgcccatcgcccgtttcactcatgtcacgcgcgcctcgggcggtccaccgactgcaagatcgcataccgaaaatcacactgcgttaacttccgcggcggtacggccaccggcccacctccgcccgcttcctcaaaagaggccgttaagctgcagagacttcatccgcggccgcgtctcccactggcgccgcccggccggaccggatactctcgggcatcctagtaggctagccatctggtgcgtatgggacgcttgcgggcatgatcctcgaagtcacacttatcgacatcctccccggccgggaggacgatttcgccgccgcctaccagctcgcccgccccctgatcgccggcgccgagggctgccacggtctgcgactcaagcgcggccacgagtcctccaaccgcttcctcctcctggtcgaatgggactccatggacgcccacgaccacaatttccgccgcaccgaacgcttcgcccagtggcgcgcctcgatcgccgccacgctcgctcagcccccgctgaccgaatacttcaccgacctgcccgccttggccggtcgccccgacgccgaccacgacttcttcgcctgacccgccccgcggcctccaccggacgcccaacatgtgaccgccatcctcaacccggccttccggcggcctgagccatcacagcggcacgaccggcgaccagttgggctcaaccaccgccacctcaccgacgccgccaccggccggcaccagactcgcctcagccctcagggcccccgaccggcccacctgccatctccacatccagcctgccgccgagaggcagcgcgggcagcgcgggcagcgcgggcagcgcgggcagcgcgggcagcgctagctagctagcacgggcagcacgggcagcacgggcagcacgggcagcacgggcagcacgggcagcacgggcagcacgggcagcacgggcagcgcgggcagcgcgggcagcgcgggcagatatggctccgtacgaatcccggcggccggaacccagcatgccgatgccgtgccgacgccgaccggccgtatcgtcactcgaccggtggagtccacgacccctgccgtgccctcccagggcgaccacggtcgcgatcggcttcgcctgcgcaccctccgcagtggtcgctgagcagccaaaacgctctaaaatggccgctgtcgagtagccacggacgcttgtttcccgggccggaatgcgtacttcgacgggctgtcacgtgcaccactggtctaaggtggtctcggcgggcccgggaagtgaccgatccgaagtgccggctccggggattggccggccgcgctggaaacagagacgctccccgacttgtcctcccgggcccgcaccattccctcgcccgatccgggccacggtcagcccaccccacaggccacaagcccgtgcccacaacgctccccaccagccaaggttacggacggggcgcccccgaagacatcgagactgacgggcttcggaaggcgaccccgcgcgaaaccgccccacctggcgccacaccgaggcaccaaagatccggacggcgttacttcaccccagcggcatccattccccgcagctccttcttcagctcggaaacctcgtcccggatccgagccgcaagctcgaactgcagctcccgggccgcccccagcatctgctcgttcaggtcctggatgagctgcgccagctcggcccgcgccatcccctcgcgggccggcccgttgcccgcccgggccttggatcgggtttccggaaccggggccttgccgcgggacatctgccgccccgcgccccccacgatcgccgagtcggtgtcctccgcctcgcggtagatgtcgtccaggatgtcgtggatcttcttccgcagcgcctgcggcttgatcccgttcgcctcgttgtgggcgatctgcttggcccgccggcggtccgtctcgtcgatcgcgtcccgcatcgacggcgtgatcttgtcggcgtacatgtggacctcgccggacacgttgcgcgccgcccgcccgatcgtctggatcagcgaccggccgctgcgcaggaagccctccttgtccgcgtcgaggatcgccaccagcgacacctcgggcaggtcgagaccctcccgcagcaggttgatgccgacgagcacgtcgtagtcgccttttcgcagctccttgagcagctccacccggcgcagcgtgtccacctcggagtgcagatagcgcacccggatcccgttttccagcaggtagtcggtcaggtcctcggccatcttcttggtcagtgtggtgaccaggacccgctcatcccgctcggtgcgcagcttgatctcgtgcatcaggtcgtcgatctgtcccttggtgggtttcaccacgacctgcgggtcgaccagaccggtcggccggatcacctgctcgacgaactctccctgtgcctgctccatctcccagttgcccggggtcgcggagaggaagaccatctggccgacccgctccaggaactcgtcgaaccgcagcggccggttgtcggcggcgctgggcagccggaacccgtgctcgatcaggatccgtttccgggaggcgtccccctcatacatcccgccgatctgcgggatcgagacgtgcgactcgtcgatgacggtgatgaagtcgtcggggaagtagtcgagcagggtgtaggccggctcgccgaaggtgcgcccgtccatgtgcatcgaatagttctcgatgccgttgcagaagccgacctggcgcatcatctcgatgtcgtaggtggtgcgcatccgcagtcgttgcgcctccagcagcttgccctgccgctcgaactcggccagccggtcggcgagctccgcctcgatgtcgcggatcgcccgctccatccgctccgggccggccacgtagtgggtggccgggaagatgatcagctcgtcgacctcgcggatcacctcaccggtgagcgggtgcaggtagtagagcttctccacctcgtcgccgaagagctcgacccggacggcgagctcctcgtacgccgggatgatctccagggtgtcgccgcggacccggaacgtgccgcgctggaaggcgacgtcgttgcgggtgtactggatgtcgaccaggcggcgcagcagcttgtcccggtcgatctcgccgccgaccttcaccttcacggcgcgctcgatgtactcctgcggggtgccgaggccgtagatcgcgctgacggtggcgaccacgatggtgtcgcgccgggtgagcagggacatggtggccgagtgccggagccgctcgacctcctcgttgaccgaggagtccttctcgatgtaggtgtcggactgggcgatgtacgcctcgggctggtagtagtcgtaatagctgacgaaatactccaccgcgttgtgcgggaggagctcgcggaactccttggccagctgggcgcagagcgtcttgttgggcgcgagcaccagggcgggccgctgcaaccgctcgatcagccaggcggtggtcgcgctcttaccggtgccggtggcgccgagcagcacggtgtgccggtcgccgcggcggacccgccgctccagctcatcgatcgccgcgggctggtcaccggccggctggtagtcgctgacgacctcgaaccggccgtcgagtcgtgggatgtcgagcgccatgcacacaccgtacgtcgggggtctgacacttttttcgcacccgcccgccgaccgcccggcgaaccactgccgcgggatcgtgccgatggtgcacattcggccgtggcgtgcggcattgtcgggtcttcacccggccgcctaccctggcggggtaggccgctcgcggcggccgccgagcacggtcgggaccagccaacggtccagccgtgccgcaccacggtcgatgcgccccggcacccggcgcgcgcacccggggaggtcgcgccttgcgactggccgccgcgagcgccgctaatccgcccgaggcgagctctcgccggcagccggctgccagcccgtcgcggtcgcccaggcctcggccgccgcagcctcctcgtcgaaccacggctccttcgccgccgcatacccggcccggtccgggaagcgcagcgccagctcggccttcgccgccgcgtaggcgtcccgcgccgccggcaccgcccgcaggtggtcccgcatcagcagggcgaaccgccaccccggcgatccggcgacccgcacgtgcagaatcaccggccgtcccggatccgacgacccgtgcacccgtttcggccacgtctgcccgggcagtccgcgcgcgttgtcggcccactcccccgatcgcgccgggaatccggcggcggccaggcgaccggcgagcgcatcggcctcgtcgagggttcgcacggacagcatcaggtcgatgatgtccttggccggcaggcccgggacggccgtcgatccgatgtgccgcacgtcggcgtcgccgagctggtgccggatccgcgtgatcagtcgctcggcggcctgcggccagcccggatcgggcggtacgatgtgcagttcgggggctttgcgggcggcggtcccggcccggacgttccgctcgaaggggagcagccggtcacgccacagcgcgtcgacccgggcgcgcaacgcagcaagatcatcctcgttgggcaggatcacgtcggcggcggcctgccgggtggcatcgtcggcctgggcgccgatccgggcggcggcctccgccgccgacatgccacgatcgcggacgagacgcccgatgcgcacctcacggttcgccgtcaccacgacgaccaggtggtacgtcggtgccagcccggtctccaccaggagcggtacgtcgttgaccacgatcgcgccggcgggcgcctcctcgatcatctcggcggtgcgcgcccgcacccgcgggtggatgatctgctccagccggcggcgggccggctcgtcgccgaagaccttggccccgagcgccggccggtccagcccgccgtccgcaccgagaatcccgtcgccgaacgccgccacgatctcggcgagcccgtccgtcccgggcgccaccacctcacgcgccagccggtcggcatcgatgatcaccgctccgagttccgccagccgcgccgacaccgcactcttgcccgcgccgatccccccggtgagcccgaccctcagcacgtggtgcccccagcacgaccgaccatcagcatgaggccagtatcccggccggccgccgcccgccgcaccgcaccccgatcacgctgggccggatgccgcgccgcaccccgatcacgccggggcggatgccgcgccgcaccccgatcacgccggggcggatgccgcgccctcgccgccggagcccctgggaagtagctgcccacccgctaccgagaccgttccaccgaaccggaggcagatgcccgtgacgggggcagggacccccacccaccggagacggggcggtgggccggggccggaaatgcggaaagaccgccccggccgaagccgggacggtctttctttgtcgctgtcaccgatgcggactcaggccgtggcccgggtcagcgtcagttcttgccgccggcaagcttctcgcgcagggcggcgagagcctcgtcggtggccagggtgcccgcgggctcctcggcggagcgcgccggggtcgacgtgctcgacgaggtcgaggacgaggtggtcacgccgccggccggagccgggttgagcgcggcctcggcgtcggcgtcgcgggacgcctgcacctgcttggtgtgggcctcccagcgctcgcgggcgtcggcgtactgcttctcccacgtctcgcgctgcttctcgaagccctcgagccactcgcccgtctccgggtcgaagccctccgggtagatgtagttgccctcggcgtcgtacgtcgcggccatgccgtagagggtcgggtcgaagtgctcctcgccctcgacgaagccctcgttggcctgcttgagcgacagcgagatccggcggcgctccaggtcgatgtcgatgaccttgaccaggacgtcggagccgacctggacgacctgctcgggcagctcgacgtgacgctcggccagctcggagatgtgcaccaggccctcgatgccgtcgtcgacgcggacgaacgcgccgaacgggacgagcttggtgaccttaccgggcacgatctggttgatcgcgtgggtccgggcgaactgacgccacgggtcctcctgggtcgccttcagcgacagcgagacgcgctcgcggtccaggtcgacgtccagcacctcgacctcgacctcctggccgacctcgacgacctcggaggggtggtcgatgtgcttccaggagagctcggagacgtgcaccaggccgtccacaccgcccaggtcgacgaacgcgccgaagttgacgatggaggacacgacgcccttgcggacctggcccttctgcagcttgttgaggaactcggtgcgaacctcggactgcgtctgctcgagccaggcgcggcgggacagaaccacgttgttgcggttcttgtccagctcgatgatcttcgcctcgagctcgcggccgacgtacggctgcaggtcgcggacgcgacgcatctcgaccagggaggccggcaggaagccacggaggccgatgtccaggatgagaccacccttgacgacctcgatgaccgagccgcggacgacgccgtcgtcctccttgatcttctcgatggtgccccaagcccgctcgtactgagcgcgcttcttcgagaggatcagacggccttccttgtcctccttggtgaggacgagggcttcgatgtggtcaccgaccgacaccacttccgcggggtccacgtcatgcttgatcgacaactcgcgcgaggggatgacgccctcggtcttgtagccgatgtcgagcaggacctcgtcccgatcgaccttgacgacggtgccttcgacaatgtcgccgtcgttgaagtacttgatggtctcgtcgatggccgcgaggaaagcttcctcagagccgaggtcgtcgacggtgaccttgttggcgctcgaggtggcctcgatgctgctcgtcatgtggacagttgctccgaacggatggattcgtggtgtctcccgcgctcgacggaactgccaccggaagcggcacgaacgaacgagacgaccaacccaggagcagtctgatcattgccagtcgatcatgccgagaccggcgaccacggaacctgctccctgccgaggcacacgttccgcgagcgcatcgactagcttaccgtgcgcattaccacaggttgcaagccctcctgaggagcgcggcacattgttcgggaagaacccgtcagcatgcccgttttgaaccgaatcaggacggccgccacgcctgtcgtaccgttgccgagtgaccgagatccccacgatcgagaaagccgcgtccgcccggccggccgccgacgagcgctcccgggcgttcgaggatgagacgcgccacgccaaccggtcctggtgggacctggacgccgacgactaccaggacgagcacggggccttcctgggcgacgtcgacttcgtctggtgcccggagcggctgcgcgaggccgacgcggggctgctgggtgacgtacacggcaggaaggtcctggaactcggtgccggcgccgcggccggagcccggtggttgcgccggcagggcgccgaggtcgcggccatggacctgtccgccgggatgctgcggcacgcccgggcggcggccgcccgcagcggtgtcgaggtgccgctggtccaggccgacgcgctggcgctgccgttccgggacggggctttcgacatcgtctgcaccgcgttcggcgcgatcccgttcgtggcggactcggccgccgcgatgcgcgaggtggcccgggtgctgcggcccggcggcagttgggtgttctcggtcactcacccgatgcggtggatcttctgggacgagccgggcgaggacgggctggtggcccgcaactcctatttcaaccgttcgccgtacgtcgagcggggcgacgacggccggatgacgtacctggagcagcaccggacgctcggcgaccggatccgcgagctggtcgccgccgggttcgtgctgcgggacctggtggagccggagtggccggagggccacgaggggatctggggccagtggagcccgctgcgcggccgcctcttccccggcaccgccatcttcgtgtgcgacctgcccggctgaggccggcgacctgcccgactgagggccggcgacctgcccgactgagggccggcgacctgcccgactgggggccggcgacctgcccggcagagggagagcgacccgcccggttgagcccgaaccagcggggtattcgccggacatggcagaagagaacctgaaaaagggcgacaaggtcacttggcgcagccacggcgagaccgtccacggccaggtcgaacagaagatcaccaagcgcaccgaggccgccggacggacggtcgccgcctcctcggacgacccgcagtaccgggtgcgcagcgacaagaccggccgggacgcggtgcacaagcccggatcgctgcaccgtggctgacctctacgccgacttccgcgcagcggtcaccatgaccccggccgccttgcgcacctggctcggcaccgaggagtcgaaggaggtcggccagaagtcgtcggcgggcgccgagtcggtcggccacgactccggccgccggatcctgcgtctgctggagaagaagaagtccgagctgaccgcggacgacgaggagcacatgcgcaaggtcgtcggctacgtacaccgccacctcgcccagcgccccgccggtgacgtccgggagacgaagtggcgttactccctgatgaactgggggcacgacccgctgagggactgaacgaccggccgcgacggtcaggacgccggctggagcaggcccgccagcagaatcagcgtcgccgggaccgcccggtagtagacccaggtgccgcgccggtcgctgtcgaccaggccggcctcgcgcagaattcgcaggtggtgcgagatggtcgggccggtcaggtggaaggcgctgctcaggtcgcagacacaggcctccccgtcgggcgccgaggcgatcatcgacagcagccggagccggaccgggtcgccgagagccttgaacatcgcggcgaacgcggtggcccgcggcgcctccagcggcgcggcggccagcccgggcccctcgatcaggatcgcgtcatcgaactcgatccccaagccgccggcgggccggggcacggccgtgatcacggtctgctccatcgacatctgttcagcctgtcagatcacggcaacgtccgaggcctccgggtcaccgaaaagtgccggagacccccgaacgagcacaaaagtggctagtggtccgcaccgttccagtcgcggccggtaccgaccgacacctccagcgggaccgcgagcgggtaggccccgcccatctcccgccggaccagctcctccagcggctcccgctcccccggcgccacctcgaagaccagctcgtcgtgcacctgcagcagcatccgggaggtcagcccggaagcccgcagcgccgcgtcgaccttgagcatcgcgaccttgatgatgtcggcggccgagccctggatcggcgcgttcagcgccatccgctgggccatctcgcgccgctgccggttgtcgctgctcaggtcgggcaggtagcgccggcggccgaggatggtcgcggtgtacccgtccttgccggcctgggcgacgaccgactgcaggtagtcccggacgccgccgaaacgctggaagtactcctccatcagcgtcttggcctcgtcgttggagatggtgagctggttggacaggccgtaggaactcaacccgtacgccaggccgtagttcatcgccttgatcttgcggcgctgatcggcggtgacctcgccgagctccacctggaagaccgacgacgcggtgaccgcgtggaagtcggcgcccgagttgaacgccgcgatcagcgccgcgtcctcggacaggtgcgccatgatccgcatctcgatctggctgtagtcggcggtcatcagctgctcgaacccaccgccgacgacgaacgcgcggcggatccgccggccctcctcggtgcggatcgggatgttctgcaggttggggtcggtggacgagagccggccggtggcggcgaccgtctggttgaacgtggtgtggatgcgcccgtcgtcggagaccgacttgagcagcccgtcgaccgtcgacttgagcttggccatgtcgcggtagcgcagcaggtgggcgagcagcgggtcctcggtcttggcgaacaggtcctgcagggcgtccgcgtcggtggtgtagccggacttgatcttcttcgtcttgggcaggttgcgttcgacgaagaggatctcctgcagctgcttgggcgagcccaggttgaactcccggccgtgcacctcgtgggcggcctgctgagcggctttcacctcggcgccgaaggtggactccagctcggagagatactccgtgtcggcggcgatgcccttgccctccatctcggcgagcaccaccgagagcggctgctccacctcggcgagcaggcgctgcgactcgccgccgtcctgggagagctcggcgatcagcacgtcggccaggtcgagggtggcccgggcgcgcagcatcaccccctcctcggcggcggtgtcctcggcctcgtcaccgaacgacagggccagctggccgccgttgtcgggagcgtcgaccttcagctcgcgcttgaggtagcgcagggcgaggtcggtcaggtcgtacccccgctggtcgggcttggccagataggcggcgagcgcggtatcggtggtgacgccggccagctcccagccgtgcgcgcggaaggccagcagcgccggtttggcgtcgtggatgaccttgggccgggccgggtcggcgagccaggcggcgaccgcctgctcgtccgcctcgtccagcgcggccgggtcgaaccaggcggccggaccgctgccggtggccaccgcgatgccggtgacctggccggtgccgcggccgaaggcgccggtcacggcgacgccgaccggagccgccgcggcgtgctcggtgagccagccggccacctcgccggcgcgcagcacgcgggcctccaggtcgaagccggactcggcctcgggctcgacggcctccaggtacgagtagaggcgctcgcgcaggacgcggaactcgagcgcgtcgaagacctggtgcacggcctcgcggtcccacccggtccagcggacgtcctcgggacgcagcggcagctccagatcgcacaccagagcgttgaggtcgtagttgcggatcacgtcggcgaggtgggcgcgcagactctcgccggccttgcccttgatcttgtcggcctgggcgatgacgccgtcgaggccgccgtactcattgatccacttggcggcggtcttgtccccgacgccggggacaccgatcaggttgtcgctgctctcgccgaccagggcggccttgtcccggtagcgcgacggcggcacgaagtatttcgcctcgatcgcctcgggggtcatccgccagacctcggagacgccgcggaccgggtagaggatggtgacgtgctcgtcggccagctggaacgcgtcccggtcgccggaggagatcagcacctccatgccggccgcgcgggcctgggtggcgagggtggcgatgacgtcgtcggcctcgtagttctccttggtgaccaccgggatgcgcagcgcctgcagcacctcctggatcaggctgacctggccctggaacggcgccggggtctccgagcggccggccttgtattccgcgtatctctcggtgcggaacgatttccgggagaggtcgaaggagaccacgatgtgcgtcggcttctcgtcgcgcagcatgttgatgagcatcgacgtgaagccgaacaccgcgttggtggcctgcccggtgaccgtggagaagttgtccaccggcagcgcgtgataggcccggtaggccagcgagtggccgtccagcagcagcaggcggggggtcgtcgcgtcgtcgctcacgtccaggaactctagaccgaccgtacgacagaaacggcgaccgccccgcccgcttcagagcaccttgctgaggaacgccttggtccgctcctgctgcgggttggtgatcacctcggccggagcgcccttctccaccaccacgccgccgtccatgaagaccacctcgtcggccacctcacgggcgaaaccgatctcgtgggtcaccacgaccatcgtcatgccgtcccgggccaggcccttcatcacttcgagcacctcaccgaccagttccgggtcgagggcgctggtcggctcgtcgaagagcatcaccttgggccgcatggccagcgcccgggcgatcgccacccgctgctgctgaccgccggagagctgccccgggtagttgccgaccttggcggccaggccgacccggtcgagcagggacagggcgcgctcgcgcacctcacccttgttctcccccttgacccggcacggggcctccatgacgttgtccaggacggtcatgtgcgggaagaggttgaagcgctggaagaccatgccgatcgactgccgctgccgggcgacctcacgctcgcccagctcgtgcagtttgccgccacgctcccggtaaccgaccagctcgccgtcgaccaggatccggccggcgttgagtttctccaggtggttgatacagcgcaggaaggtcgacttgccggacccggacgggccgagcacgcagctcaccccgccctgcggcacgaccagatcgacacccttgagaacctccagagccccgaaggacttgtggacgttctccgcacgcaccatctcggtcacggcgccccctccccggtgacggtcatccggccaccctgctccacctggatgtcccggagccgctgacgggcctgtccggccgcgccgtaccccttgccgaagtgccgttccacgaagaactggacgatcatcagcacgctgcagatgatcagataccagatcagcgcggccaccaggcagggcagcacgatgaaggtccgtgcctcgacctgggtgagctggaagaacagctccccggccaccggcacgtaggccaccagcgaggtgtccttgaccatcgcgatcacctcgttgccggtcggcggcacgatcacccgcatcgcctgcggcagcaccacccggcgcaacacctggccacgggacatgcccagggccacggcggcctcggactgcccggtgtcgatcgactggatgccggcccggacgatctcggccatgtaggccgcctcggagagcccgagcgcgatcatgccggccacgaacccggcgagcaggtcgaccgacctgatgctgaagaactggccgtcgaagttgtcgatcccgaacagccggccgatctgccggtcgaacggcaggccgaagccgatccggctccacaggatgttcaggttgccgaagatcaccgcgagcaccaggcgcggcgcggcccggaagaaccaggtgtaggcccaggcgaccgaggacagcaccttgttcggcgagagccgcatgatcgcgatcacgacgcccagggtgacgccgatcaacatcgacaggatggtcagcaggatggtgccccgcagaccctccagaaccggctcggtgaacatcacgccgcgcttgccgggggcgtacgaggagaagatgaacgaccagttgaacgcgtggttcgtaatgatcagatgcaggaacatggcgaccagcaccatgaggacgacgatcgccgcccacctgccgggatgccggacgggcacggccttgatcgctgccggccgtgcccgctcggactctgtcgcttgtgtcatgcccgggcgacgatcagctcgccgggttcaccgcgggagtggtgatcccgccggccgcgacgccccacttgtcgaggatcgtcttgtaggtgccgtccgcgatcagcgacttgaccgcctcggcgatcacgttcgcgaactcggtctgcttcttgtccacgacgtagccgtacggcgccgagtcgtagatgtcgccgagcagcgccagctgaccgttggtctgcttgaccgcgtaggcgaccaccggggagtcggccagcatagcctcgtccttgccggtgaccacggcgttggtggcgtccgactgcttctggtactggtccacggtgatcttggccttgcccgccgtggtgcacttcttcgaccgggcggtcaggtcgtccacctgcacggtcgcggtctgcaccgcgatcttcttgccacacgcgtcgtccaggctcagcgtggagcccgccttggcggcccactgggtgccggccgagaagtaggagatcatgttgaccactttgaggcggtccgggttgatcgtgaacgacgacaccccgacggtgtacttcccgctgctgacgcccgggatgatgctgtcgaaggtggccgactgccactcggtggtcaggcccagcttctggccgaccgcgttgaacaggtcgacgtcgaaaccggtgaccgtcttgccgtcggtgtccaggaactcactcggcgcgtacgacgagtcggtgccgatgaccagcttgccggccgccttgatgtcggccgggaccttacccgcgagcgaggtgtcggtggaggcgctcggcgcggcagccgagccgctgctcgtgtcggtctccttgccgcaggcggacagcgacacggtgagcgccgccgccacggccacaccgaggatcgcccgccggccgggggtgatgcggaacatgggtactcctagagggggggttgtgcagatggttaggcgacgccgaggtaggcgtccttgaccgcggggtcgtgcaggagctcctgaccggtgccctgcttcacgatccggccggtctccagcacgtacgcccggtgcgcccgggagagcgcctgctgcgcgttctgctcgaccagcagcaccgtggtgccctgctggttgatctccacgatgatgtcgaagatctgctggatcagcatcggcgcgaggcccatcgacggctcgtcgagcagcagcagcttgggccggctcatcagcgcccggccgaccgcgagcatctgctgctcgccgccggacatcgttccgctgacctgcttctcccgctccttgagccgggggaacagggtgaaggcccgctccatgtcctcattgatctcggcacggttgcgccgggtgtaggcgcccatctccaggttttcgcgcaccgtcatgccggggaagaccccgcggccctccggcgactgcgacaccccgcgcaccacccgcaggtcggcgcgcagcttggtgatgtcctcgccgtcgaacatgatcgaaccctgggcgaccgggcgcaggccggagatcgcccgcatggtggtcgacttgcccgcgccgttcgcgccgatcagcgcgacgatctcaccctggcccacggtcaggctgatgccgtgcagggcctggatccgcccgtacagcagcgtgatgtccttcagctcaagcagcatcggtgggcacccccaggtaggcggcgatgaccgccgggttgtcgcgcacctcggccggcgtgccctcggcgatcttcttgccgaactcgagcacgacgatccggtcggtgacgcccatcaccaggcgcatgtcgtgctcgatgaggagcacggtgacgcccgagtcccggatcttccggatcaggttgagcaggtcctccttctccgccgggttgaagccggcggccggctcgtccaggcagagcagggtggggttggtggccagcgcgcgggcgatctccaggcggcgctgctcgccgtaggagaggttgcggctgacctcgccggcccggtgcgcgatgccgacgaagcggagcagttccagcgacttggcccggccctcgcgctcctcccgccagaagcggggcagccggaacagggcgctgagcacgctggtcttgaagtgggcgtcggcacccaccatcacgttctccagcgcggtcatctccgggaagagccggacgttctggaacgtccgggcgatcccgccgcgggtgatctcgtgcttcttcttgccgatcagcgactggccctggaagcggatctgaccgctggtcgggctgtagacaccggtcatcgcgttgaagcaggtggtcttgccggcgccgttcgggccgatcagaccgaagatctcaccgcggcgcaaggcgaagctgatcccgttgagggccacgacgccgccgaagcgcagcgtgacgtcgtccatctccaaaagcacgtcgccggccggcttgacgtccgggtcgggcttgctgaaggagaccggctcgctgttggcccgatcggcctcttcgggcgtctcgatgtgcggctcgctcattgcggcgcggcctccttctcccggtccttgagctccatcgcgcggcgacggctcgggatcagaccctgcggccgcaccaccatgatcaagatgatcatcgcgccgaacagggcgaagcggtactcgtacaggtcggtgtggaacaccgggtcctggatgccgcgcaggcggttcggaatgtacgagatcagcgcgccaccgaggatcgcgccggcgatgttgccggagccacccatgaccacgccggccagcaccaggatcgagaactgcaggacgaacgtctgcgagttgatgaagccggtctcgccggagaacagcacgccgcccaggccaccgatgaacgcgccgatcgcgaacgcccacagcttgaacttgatcgtccgcacgcccatgatctcggcggcttcctcgtcctcgcggatcgcgagccacgagcggccgacccggctgcggtcgaggttgcgtactcccagcacgaccaggatcaccacggacaaaccgagccagaagtacgggatggcgtcggtgaccccgaagagcgggctgccgtcggagagcttgcccggcgggtgcgggatgctggagaaaccgcggtcaccacgggcccaggtggcgctggtggcgatgatccggatgatctcggcgaagccgagcgtcacgatcgccaggtagtcaccccgcaggcgcagggtcggccagcccagcaggacaccggccagcatcgtcacggccagcgaggccgggatcgcgaccagccagccgtactgcgtgtgcagcacgctgtccggcgaggtgagcagcgccgtgacataggcgccgaccgcgaagaagccgacgtagcccaggtcgagcaggccggcgaagccgaccaccacgttcaggcccagggccagcagcacgtagtacgacatctcgaacagggcggtgggccagtccacgccggtggtgacgatctgcggcccgatccccggaatccggtcgacgtacggcagcaggtaggccaggaccacgaagcccaggatcacggcccagcgcaccggagcgggctgccggcccagccagccgcgcagctggcggctgggcttgggggtgccggtgaccggcttgtcagcgacggcactcatgcgcgcgccctcccgagagactcacccaacagaccggtcgggcggaacagcaggatcagcaccagcgccacgaacgacgcgaggtgcaaccactgggtgccgaacaggccggccgcgtagttctgcagcaggcccagcagcaggccaccgagcagcgcgccgcgcaggttgccgatgccgcccaggacggcggcggtgaacgcctcgatcccgagcaggaagccggcgtcgtacttggtgacgccgatcttcaggtcgtacatcaccgccgcgataccggccatcaggccgcccaggaggaagaccagcgcgatcacccgggacttgttgacgcccatcagggcggcactgtccgggttctgtgcgaccgcccggatgccacgacccagccgggaggtgttgatgaagcggtccagcaggaacatcatcaccagggccagcccgatgatcaggagctgcaggttggtgatgtgcgtgttgccgatgctgatcacgtctttcggctggatcagcgggggcacaccgcgcggattgcggtgcgtggccacgccgaccacctcggagatgaccagcgaggcgccgatcgcggtgatcaggaaggcgagcgggggggcgttgcgcttgcgcagcggccggtacgcgacgagctcgaccgccagcgcggtgagaccggaggcgacgatcgccacgaccagcccgatgaccaggtacagcaggaccccgccgaccgacggggtggccgagttctggtcgaggccgagccagccccagacgatgagacaggcgtaggtgccgaggaggaagacctcggagtgggcgaagttgatcagccggagcacgccgtagacgagggtgtagcccagggcgaacagggcgatgatggcgccctgcgcaaggccggtaatcgtcagcggcccgaagttctgaatcagaccggaaacattcacaagtgggctccaaaacgacgaggtcggtgcggccggagatcatccggccacaccggccctacagagagttaccgcaaagcgatcaggaggccttgatctcctggtcggccttggtgtcgcccgactcgtcgaacttgaaggcccagaccttgatcagggtcgggtcgagctcgcccttgtcggtccacttgtacgtgttcgcgatgcccttgtagttcaccgtcgacaggtaggtgttgagcttgtccgcggtggtgttacccgcgtcgatgccctgcaggaggatgttcgcggcgtcgaacgcgacgtccgagtacgtgcccgcggcctcgccccacttggtcttgtaggcgttgttgaagtcctggcccgcctgctccggcggggagcaggggcaggtcaccacggtgccgaccgcggcggcgttgccggacgccttggccaggcccgggtccttcatgccgtcgccgccgagcagggtgcccttccaaccggccccggtcagctgcttacggatcagaccggcgttggtgtagtagccaccgtagaagaacgcggtcgcgccgctcgaggtcaccttctggaccagcgccgagaagtcggcctgcttgccgtcgccctcggtcttgtccgactggacgaccaggctgcccagcttggtcttcaccacgtcggccaggccggcgccgtacgccgactggtcgtcggccacgaagaccttctgcgccttcaggacgtccttgatgtaggacgcggcggccgggccctgcgcgtcgtcgttggcgacggcgcggtggaagatcttccagttcttggtcgacagcgaggtgcgggtcgccgacggggtgatcgtcgggatcccggcctcctggaagatcgggtcggcggcctcggactcgccggagaacggcgggccgacgatgccgaggatcttcttgtcggtgaccagcttccgggccacaccgggagccacctcagccgcgccctgcgagtcgaacttctcgacggtgatgcaggtcgagcccttcttctcgttgtactggttcacggccagctcgaaaccgtgctcgatgttcacgccgaggttggcggccgaaccggtgagcgcgccgaagaacgcgagcttgtagccgcagttcgaacctgacgccgtgtcgctgctcgtatccttgttacaagctgcagtaccggcgagcaggccgatcagggccaccccgccgatcgcacgcgcgagaacctgcttcaaggttggaaccctcctcataaccgaacccaccgggccaccgcacccggattggctcttgccaaccccgcggtgccgtcggcccgtcatggggcgggacgctatcccaggtgagtcacgggtggatagcgttcgaaccggctttcaccgaaccgttacgtccggtgatcggatgcacgaggagagtgttacgagcggctgcctgtcaaggtcaactcggctgaggagcgccgccggattcctgtccctcggcgaggatccggtctgctacctcgcgcatggtcatccggtgatccatcgcggtgcgctggatccatttgaaggcctgcggctcggtcatcgcgtacttcgtcatcagctcgcccttggcgcgctcgaccgacttgcgcgtctccagccggtcggtgaggccggcgacctcggactccagggcggcgatctccgagtaccgggagagggcgatctcgatggccggcaccaggtcggatttctggaacggcttgaccaggtaggccatcgcgccggcggcccgggcccgctcgaccaggtcccgctggctgaacgcggtgaggatgacgaccggcgcgatccgcccgccggcgatccgctcggcggcggccaggccgtccatgatcggcatcttgatgtccagaatcaccaggtcgggcttcagctcctcggccagccggacggccgtctcaccgtcaccggcctcaccgacgacgtcgtagccctcctcgacgagcatctcggcgagatccaaccggatcagggcctcgtcctcggcgatgagcacccgcctgcgctcggcgccagcctgcgtgtcggccacggaacctcttcccccaaacctcttctgacgcgacaccccggtatctgggtgtcaccgtcctcagcgtagtaggtaggctgtctctcgctgagcttggcatcaccgcttccagcggtgccgcccaatgacctgtccccgtagaccaaccggcagagtcgatggactcaaaatccattcagtgtgggttcgaatcccaccggggacaccagaaataccacctcgcgccgccgctggcgagtcgcgcattcatcggtgatacgcgacacatctcgccgaaacattcagggacgtcagcactgccgtcggggatggcgtgggacacaccggaaacacaacgccgcgatcatccgggaaaagccttttctgcgccgggccgcggcccggtccggcaattttccggtacgcggtcaccccgtccgaaaagcgtcccataatcgtcggccggccctggccaatctgagcgttcgccccgccgtcgcctgccccgggtgctgtcatggcagggacagcatcacgggaggcctcatgttgtggtccggttcctcaccactgaccgccgcgcgggcgggcatgtgggggttcctgatgttcgccggggccgcgtggctggtcgtcggctggagcgtgctgcgtctggaaccgaccgacctggcccgggtggccggcccgatcgtgctgttcggcgcggtctgcgaggggctgcgcgcactggccggcacccggacctggtggctgaacgcggtgctgaccgtgctgttcgccgcgaccgggacggtgatgctgctcagcgacgacaccggctggaccaccacggcctcgctgatcggctggtatctgctggtccgcggcgccgtcgacgtggctgtcgggatcatgacacggggcgtcgaccgggtgtggagcctggtggtcacggtcggcgtgctggagaccgccctcggattcctggccgcgagcccgctggcccgcggcgcgcagacgatcgtggtgatcctcggcgcgctgggggtgttgcgggcgatcgccgacctggtcaccgccctgcggctgcgggagatcgcggccaagggccgggacctgctggagttgccgccggaacgggcgaccgggctgaccggctactccgccgggcacgccgactatgaggggcccaaacaccgggcgaggcagggcgccaccgagtcgttccacgaccaggtggtgcggaccaccgccgacctcgacaggatgctggccgaggccgggatcaccgggccccgggtgccgaagaagaaggctccggacatccaggacctgccgccggcgcccgacacgctggagggtatcgagaacgccgccgcgccggagaaatccgccggcggtcactaggaaagtccccggctccgccggtggtggatcgcaagtcggccggtcgccaggccggatccgccaccggcggagcaccagtggacgggtcaggcgccgacgcggcgcaacaggccttcctggacggccgaggcgatgtgccggccgtcacgggtgaacatccgcccgctggccaggccacgggagcggccggccgacgggctggcgctgtcgtagaggaaccactcgtcggcccggaacgtgcggtggaaccagagcgcgtggtcgaggctggcgccgaccactccaccgggcccccacacctcgccgtgataggacagcaccgcgtccagcagcgacaggtcggaggcgtaggtcagcgcgcaggcgtggatcagcgggtcgtccggcaacctgccgtcgatccgcatccagacccgctgctgcggctcggcatcccggtcgccgggcggcacccagccgggttggccgacgtatcgcacgtcgaccgcctgcgggctggcgttgaacgcggcccgccggctcggataccgggccacccagtcacgcatggtgggcacgtcctccggggcgggcaccccggacggggccggctcatggtggtcgagaccgtcctcgagcgcctggaacgacgccgacatgaagaagatcgtcttaccgtactgctgggcggtcgaccggcggaccgagaacgagcgcccgtcccggatcgtctccacgtggaaggtgatcggctcggtcgggtccccgggtcgtacgaaatagccgtgcagtgaatggacgatgcgggccggatcgacggtgcggccggcggcgaccagcgcctgcccggcgacctggccgccgaacacgcgctgggcaccggtctgcgggctgtccccggtgaaggtggccgcgtcgacctgcttcaggtcgaggatctccagaagctggtcgacggcggcctggccctgcagaggctgctgcgtcatacggcggacgggtccacgagggagcccagctggtgcacgcgcagggtgttggtggaacccggggcgttcggcggggagccggccacgacgaccacgtactcgcccggcttggccaggcccaggcccagcatcttcgcgtcgacctggcggaacatgtcgtcggtgtgctcgacgaagtcggtcaggaaggtctccacaccccagctcagggccagcgtgttgcgcacctcggagaccggggtgaacgcgtagagcggcaggtcgcagtgcagccgggcgagacggcgcacggtgtcgccggtctgcgagaaggccaccagcgccttggcgccgatgttgcgggcgatctgcgaggcggcgatggtgagcgcgccaccgtgcgtcttcgggtcgtgctgcagccgggccacgcccaggccgccgccctcggtggtggccacgatcttggccatcgtgctcaccgtgagcaccgggtacttgccgacgctggtctcgccggagagcatcaccgcgtcggcgccgtcgagcaccgcgttggccacgtcggaggcctcggcgcgggtggggcgggaattctcgatcatcgagtcgagcatctgggtggcgacgatgaccggcttcgcgttctcccggcacagctgcacggcgcgcttctgcaccagcgggacctggtccagcggcagctcgaccccgaggtcaccgcgggcgaccatgacgccgtcgaaggccagcacgatcgcctccaggtggtcgaccgcctccggcttctccaccttggcgatcaccgggacacggcggccctcctcgtccatcaccttgtggacgagcttgatgtcctccggcgagcggacgaacgagagcgcgaccaggtcgacgccgagcttcagggcgaagcgcaggtcctcctcgtccttgtcgctcatcgccgggacgctgaccgcgacgttcggcagcgagacacccttgttgttgctgaccgggccaccctcggtcaccaggcactggatgtccttgccgtcgaccacgccggtgacctcgacggcgaccttgccgtcgtcgatcagcagccggtcgcccgccttgacctccagcggcagcggcgtgtaggtgcaggagacccggtccttggtgccgaggatgtcgtcgctggtgatgacgacccggtcaccggtctcccaacggtgcgggccgtcggcgaacttgccgagccggatcttcggaccctgcaggtcggcgaggatggcgaccgggcggtcggcctgcgtggcggcggaccggaccagctcgtacatctcccggtggttctcccgggtgtcgtggctgaagttcatccgggccacgttcatgcccgcctcgaccaggccgagcatccgctcgggtgacttggtggcggggcccatcgtgcagacgatttttacgcggcgtgtcacggccatcaggctagtccttctcctggggcggctcggcgagcgacccccgtcctcggcatgaattgcgggtgtcgacggcgaggtaaacccgggaaaacacgggaacgctacgtcgtccgcgggcttcagcgaccgccggaccagcttatcggtcgccttccggcgaccgccgtcacatgccacaacacctttccgggtacgtcgatcaaggagccgacctgcacaaagaggcccgtcacccgcgctttcgggtgacgggccgcagtgaacgtcgactcagaccgacaggggctgctggtcggagcggaccggtgcgggcagttcccccgccgaacccaggtagtcgtggatcgccgacgcggccgaccggccctcggcgatcgcccacacgatcagcgacgcgcccttgtgcatgtcgccggccacgaagaccccctcggccccggtctgccagccggcgtccgcgtccagcacgttgcgccggttgcgggtcagcccgaactgggccagcagcggctggtcctcggtgccctcgaagccgatcgccagcagcaccaggtcggcgcgcagctcgcgctccgaacccgggaccacggagaccgtgcggaccccgtcgatccggcgcaccgacacctcggccagccggatcgcgaccaggttgccgtccgcgtcgccgacgaattcctggaccgcgacgccgaagacccggtcgccaccctcctcgtgcgccgcgtagttgcgcaggatgaccggccaggtgggccacgggtccttgacgccggtgcggaactccgggggcagcgggtactggtcgagctgggtgaccgaggcggcgccctgacggtgcgcgacgccgaggcagtccgccccggtgtcgccgccgccgatgatgatcacgtgcttgcccttggcgtcgatcggcgtggtgtcctgcaggccggcgacgatccggttggccgggaccaggtggtccatggccaggtgcacgccgttgaggtggcggcccggggtttccggggtgtcccggccggccagcgcgcccgcggcgagcagcaccgcgtcgtaccgctcgcgcaggtcgtcggcggtgatgtcgacacccacctcgacgccggtctggaactccacgccctcggcggacatctgggcgagccgctcgtcgatcacgtgcttctcgatcttgaagtccgggatcccgtagcgcagcaggccaccgatccggtcgtcccgctcgtagacggtgaccgcgtgcccggcccgggccagctgctgggcggcggccagaccggccgggccggagccgaccaccgcgaccgacttgccggacgcggccggcgccggctgcggcaccagaccccgcgcgaacgcgtggttcgcgatctcgacctcgacctgcttgatcgtcaccgggtcgtcggcgatgcccagcacgcaggccgcctcgcacggcgccgggcagagccggccggtgaactccgggaagttgttcgtggcgtgcagcgactcgatcgccgcgtcccacgccccggtgcgcaccaggtcgttccagtccgggatgcggttgcccagcgggcagccgtcgtgacagaacgggatgccgcagtccatgcagcgggtggcctggtcgcggatcagctcctcgcccgcgggcgggtagacctctttccagtccatgatccgcaccgggaccggacgccgccggggcagctggcgctcgtagcgcaggaaaccgttcggatcaggcaccggtgacccccatgaccgcctcgtccacgttgtgaccggcggcttcggcggtcctgatcagctccatcacacgcttgtagtcgcgcggcaccaccgcggtgaaccgctcgaccgcggccggccagtccttgagcagacgctcggccaccgccgactcggtctccgcgtggtgcttctcgaccaacgagcgcagcgtgtcgcgctcctcgtcggtcagcggcgcgaggtcgaccagctccgggttcaccagatcctggaacaggtcgagcacgaacgccttgccaccgctcatgccggccgcgaagttgcgcccgatcgggccgagcaccaccaccgtgccaccggtcatgtactcgcagccgtggtcgccgacgccctcgacgaccgcggcgccgccggagttgcggacggcgaaccgttcgccgacgcgcccgcgcaggaacagctcgcccgcggtcgctccgtacaggatcgtgtttccggcgatggtgttgtcctccgccgtgaacggcgcgtcctcggccggccggacgatcacccggccgccggacaggcccttggcgacgtagtcgttgctgtcgccgatcagccgcagggtgacaccgcgcggcaggaaggcgccgaacgactggccaccggtgccccgcagggtgaactcgatggtgtcgtcgggcaggccgttgccgccgtagcgccggctcacctcgccgcccagcatggcgccgacactgcgctggtcgttacgggtgcgcagcgcggcacggaccggcttgcccttgatcagggccggctgggccagcgcgatcagctcgttgtccagagccttctccaggccgtggtcctgggccaccacgccgcggcgggccgcgttctcgggcagctcgggaacgtacaggatcggcgccaggtcgagacccttggccttccagtggtcgatcgcctcggtcacgttgaggatctcggcgtgcccgatcgcctcctcgatgctgcggaagcccagctcggcgaggagctcacggacctcctcggcgaggaagaggaagaagttctcgacgaactccggcttgccggtgaaccgctcgcgcagcaccgggttctgcgtcgcgatgccgaccggacaggtgtccaggtggcagacccgcatcatgatgcagcccgagacgatcagcggcgccgtcgcgaaaccgaactcctcggctccgagcagggccgcgaccaccacgtcccggccggtcttgagctggccgtcgacctgcacggtgacccggtcccgcagcttgttcagcagcagggtctgctgcgcctcggccaggcccagctcccacggggtgccggcgtgcttgagcgagttcagcggggacgcgccggtgccgccgtcgtggccggagatcaggatgacgtcggccttgagcttggcgacccccgccgcgaccgtgccgacgccgatctcggagaccagcttgacgtgcacccgggaggccgggttgaccatcttcaggtcgtggaccagctgcgccaggtcctcgatcgagtagatgtcgtggtgcggcggcggcgagatcaggccgacgcccggggtggcgtgccgggtcttggcgatccacggccacaccttgttgccgggcagctggccgccctcgccgggcttcgcgccctgcgccatcttgatctgcaggtcgtccgcgttgacgaggtattcgctggtcacaccgaagcggccggacgcgatctgcttgatcgccgagcgccgctccgggtcgtacaggcgctcgacgtcctcgccgccctcgccggtgttcgacttggcgccgagccggttcatcgcgatcgccagggtctcgtgcgactccgcggagatcgagccgtagctcatcgcgccggtggagaaccgcttgacgatctcggcggccggctcgacctcgtcgatcggaaccggcgtacggtcgctgtcgaaccggaacagcccgcgcaacgaacccgcggcgccggccagctcgtcgaccttgctggtgtagcgcttgaacacgtcgtactgcttgctgcgggtggcgtgctgcagcaggaagacggtctccgggttgaacaggtggatctcaccctcgcggcgccactggtactcgccgccgacctcgaggcggcggtgcgcccgctcggccgggttcgccgggtacgccttctcgtggcgcgccttgacctcggcgtggatctcggccaggccgaccccgccgatccggcccgaggtgcccgcgaaataccgctggagcagcttgttgtccaggccgacggcctcgaacacctgtgcgccgcagtacgaggacaccgtggagatgcccatcttcgacatgatcttcaggacgcccttgccgagcgccttgacgtagttgcggaccgccttgcgcgcctcgatgccggccagcgcgccggtggcgatcaggtcgtcgacgctctcgaaggccaggtacgggttgaccgcggccgccccgaagccgatcagcaccgccgcgtggtgcacctcgcggcagtcaccggactccaccaccagggccacctgggtgcgggtctgctcgcgcaccaggtgctggtgcaccgcggcggtgagcagcagcgacgggatcggcgccaggtcggcgttggagtcccggtcggagagcaccaggatccggacgccgtcctcgatcgcctcggagacgtgccggcagatctgggtgagccgggccttgatcccggcggcgccgtcgcgcagcgggtacaggccggagacccggaccgccttgaagccgggcaggtcgccgtcctcgtcgatggagagcagcttggccagctcgtcgttgtcgatcaccgggtacggcagcaccacctgacggcagctggccggaccgggcttgagcaggttcgcctccgggccgatcgtggtgcccaggctggtgaccaactcctcccggatggcgtccagcggcgggttggtgacctgcgcgaacagctggtggaagtagtcgaacagcaggcgcggccggctggacagcggcgagatcggggtgtccgtgcccatcgagcccagcggctccgcgccgctgcgggccatcgggccgaccaggatcttcagctcctcctcggagtacccgaacacctgctggcggcgcagcaccgagtcgtgcgtgtagatcacgtgctcgcgcggcggcaggtcggccagctcgatcagcccggcgtgcagccactccgcgtacggctcggcggcggccagctcggccttgatctcgtcgtcgtgcgcgatccgtccggccgcggtgtcgaccaggaacatcttgccgggctgcaggcgacccttggcgaccacgtcggccgggtccaggtcgatcaccccggcctcggagccgagcacgaccaggccgtcccgggtgtgccaccagcggcccgggcgcaggccgttgcggtccagcaccgcgccgatcacggtgccgtcggtgaaggcgaccgcggcgggaccgtcccacggctccatcaggctcgcgtggaagcggtagaaggcacgccgcgccgggtccatgcccgggtcgttctcccacgcctccgggatcatcatcagcatcgcgtgcggcaggctgcgaccgcccaggtgcagcagctccagcacctcgtcgaagctggccgagtcggacgcctccggcgagttgatcgggaacagccgcttgatgttgcccggcaggttaggcgtggacagcagcgcctcgcgggcggccatccagttcttgttgccgcggatcgtgttgatctcgccgttgtgcgcgatcagccggtacgggtgcgccagcggccaggacgggaacgtgttcgtcgagaaccgggagtgcaccagggcgatcgcgctggtgacccgctcgtcggtcaggtccgggaagaactccggcagctgctcgggcgtgagcatgcccttgaacgtgatcgtccgcgaggacagcgacgggaagtacgccgcgacgccgcgctgcgagctctcccgctccgcctgcttgcggatgcagaacgccacccggtccagctcgatgccggtcaggcgctcgccggcccgcccggccggcgagtcgaccagccggtgcgcggccaggaacacctggcggatggccgggcgcgcgtcctcggcggtggcgcccagatcggcggggttcaccgggacgtcgcgccagccgagcagatcgccgccctcgaccagggcgtacttctcgaagactttgatcgcccgggccgcctcatccggatcggtcggcaggaatgccagaccggtcgcgtaggcgcccgcctcgggcaggtcgaaatcggtgaccgcgcggtagaactcgtccgggacctgaatcatgatcccggcaccgtcgccggtgttctgctcggcgccacgcgcgccccggtggtccaggcggatgagcgccgacaggcctttggcaaccacgtcatggctacgacggccgtgaatgtcggcaacaaaggccacgccgcaggcgtcacgctcgaacgccgggtcgtacaacccctggggatgcggatatgccaccgggcctcctgtcgtctctggtgtttcggatcaaggtcgggacgacgtcggccctgcaaagtctcttgagtctacgttaagagacactgatctccgccaggtgcggattgatcacaccttgcgccgggatctcggcattgtgtggacgaactgaatagcacagccggaccggcggccggtagtctcgcgcgatggcacgagcggaatccgaccacttcgaccggctcgaacagttctacgatgctttgccccggccgtgggcgcggaccgaggagatcggttccctggtgctcttcgtccgcgacggcgagggctggccctactatgcccggccccgccgcggcgcgcccaccccctccgcggccgacctcaccgcggcccgcgcccggcagcgggagctgggcgtcccggagtccttcgagtgggttcacgagaccacccccgacctgctcgcggtggcccggtcggccggcctggaggtgctgctcgcgccgctgctcagcctcgacccgcaggccctggtcccggacctgccggtgcccggcgcgacgatccggctgctggaccccgacgaccccgatctggccgcccggctggccgcctcgcgggccgtcgcgcggctcgccttcgccgcgccggcgtatcgcaccccggccgaggtcgccctggtcatcgacggtgcgggcggtaccgaacgggatgccgcggcgggcctgggggtcagcgaggagcaggtgcggcagacgcgcgagatgctggccggcggggattacgagatggcggtcgtcgagtcgccggccgagggcaccctggccaccgggatcagtcagcgggtgggcgacgtggcggagatcgccggggtggcgacgctgccggccgcgcgcgggcgcggctacgcgtcccagctcaccgcgacgctcgcccggaatctgctgggccgcggcgtcgagctggtcttcctctcggcgggcgacgacgacgtggcgcggctgtacacgcgggtgggtttccggcggatcgggacggcctgcatcgccgaaccggcggcggcgccgctgtgatcggggaatggctcacacttcccaacttctgagatcgatccgcggctaccggcgcgccgccctctcccgcggcggccgggaaaacgactgtgaagtggatcattcgtcccagaattcggaagcatagcggggctctagcctaagaatcttcggccatggccggctttgcagcgtacgaagttcggctctcgatccacctgtggacaaccggcttcacggcccgtcgcgttgtccacagggtccgggcgggccggacgcgaagcggggatcctggccgcatggcacacacccctccaggccaccggtccgggccggacgactccggatcagtccggtggcgaccagtccgacaccgggtcgagggtgcgccccaggatgcgggggcgcatgtggttcagggcggcgtcccgggcccgcagcgccagccgcccccgagcctggaccaccgcggacatccggcggttctgccgcaccacggtcgtggtccgcggctgccgcagccgggtgtatccggccatcgcccgcagcagcgcctcccccggcgcggcgtcggccagcagcgcgcgcagggtcgccgcgtcctcgaaggcgaggcacgcgccctgacccaggtggtgcggcatggcgtgcgcggcatcaccgatcagcaggacgccgcccggaccactgggaaaggcgtaggtgcggggcagcggccgcagctcgcggacaccctgcgggacgagctcctccggccgggtcagcgacagcagctcaccgaccggctcgtgccagccggcgaaccaccgctgcagcagggcgagctgggtggccggcggctccgggcgggccgcaccggccgccgtcgcgacccagtagatgccgcccttgccggcggcgtgcgcgccgagcgggatgctgacgaaacggtatccggcgccgagcgtctcgccgcccagcgcccggccgccgatcagtcgcggcacccggtatcccgggatgaccgcctgccaggcggcgaaaccggaaccgaccgcgaccgactccggcgccagcgcggcgcggatccggctgtcgatgccgtccgcggcgaccagcaggtcggcttcgatcagggtgcggccgtcaccgaccgccgggcggtcccgcgggccggtgcggaccgtggtcacctcgaaaccggtccggatctcggtgtcgccgaggcccgcgaccagcgcgtcgtaaaggtcctccaggtgcgccacggccggggccgggccgccggcgccggtccgctggcggggcggcaccagccactagctagctagggggcggccgaggccgaccaggcaccgtccgggtcgagcgagtccagggcacggcggccgttgggccagaggaccacggcggtgggcggggcggcgatccgctcggcgcgctccacaagcgtgacctgccagccggtgcgcgccagcgcgccggccgtggccagaccggccggtcccgcgcccaccaccacggccgtccgcatgcgccgctcgcctttccgcgatccgccggtcagcggtcgccggcggggcggtcggccgtttccaccggcccggcgggctcctccggctcgcccgacctgtccgcacgatcgaccaccggagccgccggggccgccgacgaggcgggctcgtcggcgcggtcgaccaccggcgttgcctgcggcgcggagtcgtcatgaccggcggtggtctccggagggagcacgccggtctcctggtacgcccggaaacggtcctcggtgacgatctgataggcgaccggcgccttcttcaccgccggggtggcgtcgacgtcgacggtggagaccccgccctcagcggcggaagcggcgggggcggcggcgaccggctcggtgtccggggcgtcgatcggcaccgcgtacgcccgcgggccacgcaccacgatgaagtagatcagcgcgccgaggaagacgacgatcgaggtgaagacgttgagccggatgccgaagaagtggttcgcctcgtcggtgcgcaacgcctcgatccagcagcggcccgcggtgtatgccatcacgtacagggcgaaggcccggccccgaccgaacttgaatctccggtccagcagccacaccaggccgccgacgccgaggtcccagatcgcctcgtacaggaaggtggggtggtagaggtcgggcagcgtgatcggctggccgtcgacctgcgaggcgtgccccgggttggccgagtccatctcgtgcacctgcaggccccacggcgcggtggtgaccttgccgtacaactcgttgttgaaccagttgccgaaccgaccgatggcctgcgcgatcggcagggccggggcgagcgagtcggcgaagatgctcagcggcaggccgatctggcgagccgcgatccacgcgccgagcgcgccgccggccaccgcaccccagatgccgaggccgccctcccagatgtacagggcgcggaccgggtcaccaccggagccgaagtagtcctgcggcgaggtaatcaggtgatagatgcgggcgccgatgatgccgaacggcaccgcccacaccaccaggtccagcgacacccagggcgcgacaccccggtgacgcagccgctgctccatgagcagggtgctgacgaccatgccggcgatgatgcagagcgcgtaggcccggatcggcaacgggcccaggtgccacaccgacgtggtgggactggggatgagggcgaagttcacgggtgcaggctaccgtcgcgcgactcgttggcaatgccccggggcggtcccggctcagggccagagctgttcccggtgccacccgtcggaggtccggcgatagcgcagccggacgtgccgccgggatgcgtcaccctgccagaattcgacgctgtccggggccacggcatagaggacgtgactggccgggacgaaatccggatgctcggcgagcagtcgctccgcttcggcggcggccaggcccacgtcggccgggtcggcgatcacgtcgctctgcgcgctgttcagggtggccagccggctcccctgggggcggccgaggaagtccgcggcggcggcctccgggccgaggtcgaccacggtgccgcggacccggatctgccggccctgctcgtgccagtgcaagccgagggcggcggccgggttcgcggtgagctgccggcccttggcgctggtccggttcgccacgaactgccagccccgggcgtccaggtcgcgcagcatcaccacccgggtgtcgggccgggcctgctcatcgacggtgctgaggaacatggtgtgcggctcgcgcaccccggcgaccaccgccgccccgagccagcaccggaacagctggaacgggtcgtccggggtgtcgcccgggtcgaagcggggcaggtcgcccgccatgaccggcaggctccgcagcaaccagccgatgtcccccatcagctcgcggcgtcgaagcggccgcgcacgccctcggccagctcggtgctgagcgcccgcaggcggtccagcccggccgtgcggtcgggcgcctccagcacgcagcggatcagcgcgctgcccacgatcaccccgtcggcgaaggcggccacctcggcggcctgcgcgccgttgccgacgcccagccccaccccgaccggcaggtccgggtcgatcgcccggatccgggagaccaggtcgggcgcctgcgaggagaccgtcttgcgggcgccggtgacgcccatcagcgcggtcgcgtacacgaagccccggcagttgcccagggtcatcgcgatccgctcgtcggtggaggacggggcgaccaggaaggtgcggtcgatccggtgccggtcggaggcggcgatccagtcgcccgcctcgtccgggatcaggtcgggcgtgatcaacccggtggccccggccgcggcgaggtcgcgggcgaacgcgtccaccccgtacttctcgatcgggttccagtacgtcatcagcacgaccgtggcgccggccgaggccaccgcctcgatgatcttcagcgtgtcccgggtacggaccccgccggccagcgcgatgtcactggccttctggatcaccgggccgtccatcaccgggtccgagtacggcagctcgacctcgatcacgtcgcagccggcctcgtgcatcgcgatcatctgctcgatgctgtagtcgatcgtcgggaagccggccggcatgcagccgaccagcaccgcgcggtcctccgaccgggccttggcgaaggtctcggcgatgcgcacggtgccgctcacgtgttctccccggggacgaccgtctcgaccgggtcgaggatgccgaagtacgcgccggcggtgtgcacgtccttgtcaccgcggccggacaggttgaccacgatggtcggggtgcggcccagctcctcgcgcagccgcggggcgatcttcgcaacgccggccagcgcatgcgagctctcgatcgccgggatgatcccctcggtgcggcagagcagctggaacgcggccatcgcctcggcgtcggtgaccggctcgtagctggcccggccggtgtcgtgcagccaggcgtgctccgggccgacgcccggatagtccaggccggccgagatcgagtgtgactcgacggtctgcccgtcctcgtcctgcagcaggtaggtgcggttgccgtgcagcacgccgaccgacccgccggtgatcgacgccgcgtgccggccggtctccacgccgtcgccgccggcctcgaagccgtacagccgcaccgcggaatccggcacgaacgcgtggaagatgccgatcgcgttggagccgccgccgacgcacgccgcgaccgcgtccggcagccggccgatctggtccaggcactgctgccgggcctcgacgccgatcccgcccacgaagtcccggacgatctccgggaacgggtgcgggccggccgccgtgccgagcaggtagtgcgtggtctcgacggtggagacccagtcgcgcagcgcctcgttcagcgcgtccttcagggtgcgcgagccgttggtgaccggcaccacggtggcgcccagcatccgcatccgggccacgttgagcgcctgccgctcggtgtcggtctcccccatgtagaccacacactcgaggtcgagcagggcggccgcggtcgcgctggccacaccgtgctggccggcgccggtctcggcgatcacccgcggcttgcccatccgcttggcgagcagcgcctgacccagcacgttgcgcaccttgtgggcgccggtgtggttcaggtcctcgcgcttgagccagatgtcggcgccgagccgctcggacagccgcgtcgcccggtagagcagcgacggggtgcccgcgtagttcagcagcagatccgtgaactgcgcctggaaggcctcgtccaccttggccgaacggtaggccgcctccagctcgtccagcgccttgatcagcgcctcggggacgaaccggccgccgtaccggccgaagtggccggccaggtcgggcagcgtcgggacggtcatcggaccggcctcggggtcgccggatggttgccggcgttgaccagctcggccaccgcgtcccgcggcgacttctgggtcaccaggccctcgccgaccagcaccgcgtcggcgccggccgacgcgtagcggatcaggtcgtgcgggccgcggacgccggactcggcgatcttcacgacgttctgcggaaggccgggggcgatccgctcgaagaccgaccggtccacctcgagggtgcgcaggtcacgggcgttcacgccgatcaccttcgcgttcgcctccagggcgcggtccgcctcctcctcgttgtgcacctcgacgagagcggtcatccccagcgactcgatccgctccagcaggccgaccagcgcgttctgctccagcgcggcgacgatcagcagcaccatgtcggcgccgtgcgcccgcgcctcgtgcacctggtagctggagatcacgaagtccttgcggagcaccgggatcttgaccgcggcacgcaccgcgtccaggtcgtccagcgagccgccgaaccaccggccctcggtgagcacgctgatgcaccgggcgcccccggccgcgtactccccggccagctcggccgggtcggggatgtcggccagcgcgcccttggacggcgacgcccgcttcacctcggcgatcaccgccacgccgggcttgcgcagcgccgcgtaggcgtcgatcgccggcggcgcggccgccgcgagctcacgcacctgctccagcggtgtccgcgcctggcgtgccgccacatcctcgcgcacaccggcgaggatctcctcgagaacgttctgcggccgcacgggtccgccactgcccgcttccgcctgatcggatgtcaccgtaatgactcccctctccgggtgtcttcggcccgatgctaggcggccaggcctctccccgggctcccggggtatggcgcgcctcacgaggtggactggggcataatgccaggctgcccgcttcggctgtcacgtcgctcacatccggcgagcggccctcccccgcgtgtgctgggacccctcccccgatcggcccacccccacgcagcgttgacacgggcgtcaccgagcggaaatacgactccggcatcgtatgtctcgggcagacttgtccacggcgtcgacggcgccgccacccggacgatgatgcggagtcgaccaatggccactgatcagaacggtttcgccgaggtttcgcgggccctcgtcgccatcgccgctgacgtcgtgaccggcgtgcagcgcgtggtggtgggtccggacaacatgcgcaccgcgcgggacaacgcgtggtcggccatcgaggccgaccgggcgcgggccgcggcccgcgccgagaccagccgggcggtcgccgccatgctggcctccggccggacccgacggacggtcgcggccacccgccaccgcacccggcaggtcgccgccacggtccgctgatgatgcggaaagtctcttaagcggtcggatcgtccccgcggtccagcgcgtcccagaccgcccggttgccgtcgggcgcggagaccgcgctgacctgcggcttgcgctcatatcgggcggacatcgcggcccactcgtggccgtggcgggcggcgagcaccccgcctgccgcgaccacgaggccgcccagcaccgccgtgaccgcccagaccgaccgccccggctagctagctagcggcgcccgcggcggccagcaggacgcccagcgcccgccgggccaccccccgggtggccagcagggcgccggccccggccagcgcgaccacggccagcccgatcagccacggctggtcgtcggcgccggtgcgcccggtgctcagatcggacaggccggggcggtgttccacggtcagcgaccacgtccgggtgacggcgtacagcgtcagcccggccccggccaggcacccgagcaccgacgcggcgtgcgagcggcggctcatcgggcggcgcgccgggtctccgcggcggcgatcgcggccagcacggcggccgccttgttccgggtctcctgctcctcggccaccgggtcggagtcggcgacgatgccggcgccggcgccgacgtacgccaccccgtccttgaccagcgcggtccggatggcgatcgccatgtccatgtccccggcgaagccgaagtagccgaccgtgccgccgtacagcccgcgacgtgtcggctccagttcctcgatgatctccatggcccgcaccttgggcgcgccggacagcgtgccggccgggaacgtcgcggccagcgcgtcgaacgcggtccggtccgcgcgcagccggccgaccaccgtggagacgatgtgcatgacgtggctgtaccgctcgatccgggcgaactccggcacctcgacgctgcccggctcgcagacccggcccaggtcgttgcggcccaggtcgaccagcatcacgtgctcggcgcgctccttcgggtcggccagcagctcggcggcgagcgcggcgtcctgctccggggtggcgccgcgccagcgggtgccggcgatcgggtgcagcagcgcggtccggttcgcgctgaccttgaggtgcgcctccggcgacgagccgacgatgtcgaagtcgtcgaagcgcagcaggtacatgtacgggctcgggttggtcgcccgcagcacccggtagatgtccagcgcgttcgcgtcggtcggccgctcgaaccgctgggccaccacgatctggaagcactcgccggcccggatcgcctccttggcctgctccaccgctttctggtagtcgcccggcgcggtccggctgaccggctcgccgggcgggcggcgctccaccgtggagaccatcggcggggtgggccgggacagcgcggtggtcatcgcgtccagccggccgaccgcgtggtggtacgccgcgcgccggtccgcctcgctcgcgtcctcggccagcaccgcgttggcgaccagcagcgccgagccgtcgtggtggtcgagcaccaccaggtcggtggcgagcatcatgcccagctcgggcagcggcacgtcgtcggccgcggtggccggcagccgctcgaagcggcggaccaggtcgtagctgagatagccgaccatcccgccggtcagcgggggcaggccggcgtccggaacggcgccgccggtcagcgcggccaccgtcgcccgcagcgcggccaccgggtcaccgtccagcggcaccccgtccggcggcgtgcccagccaggccgcctggccgtcccgctcgaccagggtggcggcgctgcgcaccccgatgaacgaataccgcgaccaggccaggccctgctcggccgactccagcaggaaggtgcccgggccgccggccagcttggtgtagacgcccaccggcgtctccccgtcggccagcagtttccgggtgaccggcacgacccggcggtggatccggacgaacgccgcctcgtccggaagggtcgctccgctggtcactggccctcccgaggcagctcgtcgaagaagcagttgtgcgctccggtgtggcacgccgccccggtctgctcgacggtcagcagcagcgcgtcgccgtcgcagtccagcgccacccggcggacccgctggtggtgcccggaggtggcgcccttcacccagtactccccgcggctgcgcgaccagtaggtggcccggccggtggtcagcgtccgatgcagcgcctcgtcgtccatccaggccagcatcagcacctcgccggtgccgtgctcctggacgatcgcggcgaccaggccgtcgggggtgcgtttgagccgggcggcgatcgacgcgtctagtgaggtctctgcatctgacacgatcacgattctcccccaccgccggcgccacccggcaccggccggggaggggccacgatccgggcacaggggatgtgccgggccgatcgggacggtaccgtcggcggggcgccgcaccgccacagatgccccggcgcccgccgccggtgtgtctgcgcagctcctggcctcggtggcgcgcctcgcgacgggagtggtcacatggagccgacgtccagccccgacaacccccggccggccccgggactcgcccgtttctggcaggtccggccccacccggacagcgccgcggagatcccggtggccgccccgacggagcaccgccggccggtcgacccgctggagctcgggctgcccaccgacctgctgaccggcgcatccatggcgttcagcgtgcgtggcgcgtccccgttcggcccggtcgccgcggccgacgggccacacggcgccaacggctccgccggggaaccgggcgatccgccggccggcgatccgttcggcctgaaccgggccgcgagccggggccccggcgccgcccggggtgaccacagcggccgcccgccggcccgttcccggcacggcgattctgatcactcgaccccttcggaccctgaaccggagggcacccaggacgtagagtcccaggagcccgcggccggttcacccgtccgggagacctctttcgggggattccggctcggcggcaccgggcgcttcctcttcggcggacggacccacgacgcgcaaccgggcgtcaacgggcacggccccgcggaggagtcatcggccgcggaggagactcccggcgacgctcaggtcgccgaagcaccggtcgacgaggagtccaccgggaccgctccggaggacgagccggcggacgacgctccgccggaggccgggcaggacaccgccgacgcggcggaacgcgacgagaacggacgtgagcacatgaacggacgggcaggagcccccgggtacgcccaggcccccgacatgccgggcccggcggaggcacccgcggcggacggcccgctcgacgacgccgccgagccgcacccggccgccggctgggcgtcggtcccggtgccctagctagctaggccgccggccgctccgccgacgccggccacgccgcagatcccggccagccgcaccccggtcgaccagccgccggccgccccggacaccagcttcgcgttcggctcgccggccaccaccggttacagcctgggccgctccggcgaggtgtacggggtcgcctcggtcaccccggccggcccgtccgcgccgcagcccggctcggtcaccccgccgccgctggagttccagccgttcccggagtccggcctgagcggcatctcggtcggcaccggccgccgcggccgcaccgacgacgccccgcacggtgctccggacgggacgccgctcgacgggaccccgctcgacggtgccgccgacacgacccgcggcctggccgacgagacgctgcgtggcgcgtccggcaatgccggccgtgggctgatcgacgacgtctaccgcgtcccggcgcctgacgccccccgcggcctgaccgatgaggccctgcgcagcctcgccgacggcgagctgaaccgcggtctcaccgacggcgagccgggccccgccgcccgtcgctcggccagcctggaggacgccgagccggtccgccgcccgggtcggcgcgccgtgcccgacaccgacgacaccggcctggacggcgccgccggcgacgaggagagcgcggcggtcatccgccccacggtctgggacgaggacgccgcccgccacttccgcgccgcctggcacgaggtgaaagcggagttcgtcgacgacccggtcaacgccctgaccagggcacacgacctgctcaccgacgcggtcaacgagctgaccgaggtcctgctggccgaacgcgacgacctcgacccgctgcgcggcaccgacaccccggacaccgagagcatgcggatggcgatgcgcggttaccgggaattcctggagcgcatcctctccctgtaagcagttcgtcgcagagacgcgagaaaagcgggcggcccgggcagcgggccgcccgcttttctcgctgcccgcttcaccgcggcatcggtgagcggggcgggatcccaccgcccggcagcggcagtgggtgggcgacgggatcccgggtcaggcggcgcagcggcggcagaggatggggtgcaggaggtgggcgaggtcctgccggtcgctgaccgggcggggaaacgccagccgggcgctgcggccgttcagacggaccacgaacccgtagcggtccatccgcaccacgcgcggctcgtcgccgggatgcgcggcggggcccagctgacgtcgtacgtaatcgcccatctcggcggaatgatggtcggcgaggtcagcgatcagatcgaattcgacggcgcgcaacggatcgggcgccgccgcggcgtagtcgtcagggtcgatctcgaccaggtgcccaccgcgctcgaagcgcacctcggccacgtccagccggtagatcgcctgtgtcccgcccacgtcgagcaggtccccgcaggcatccgtgtcggcgtagtcgagggccgcggcccgctcctcgtcgccgtcgagccgggccgcccagccggacacccagacccgtccgatcaccggcgaggtcaccatcggcggcacgtcccggatgtccagcaccagcgcggcgtcgtcgttgcccggctgcggccgcagcgcggcggccagcgcgctgccggccggcaccaggagcagcggccgcccctgcgcgtcggtgacgtgccggaccggcagcggcccggggtggcaggcgatgtgggcgacggcgggcaggtgaccggcggcgagggttcgcgcgatctcggcgggactgggttgcatgacgagcacctccgggcaccggttaggcttacctaagttaggcaaggctaaccgtaacaggagaaccgcgttgaacaactcccgacccaaagcgaagctgtcccgggcgctgggcatcccgctgacccgcaagtgtgtgaagtacttcgagcggcgcccgttcccgccgggcgtgcacggccgcggccggcgcaagagctcggactaccaggtccggctgctggagaagcagcgcctgcggcaccagtacaacatcagcgaggtgcagatgcgggccgcgtacgacgccgcccaccgggccgggggcaagaccggcgagaacatggtcaccctgctggagcgccggctggatgccaccgtctaccgggccgggctggcccgcaccatctaccaggcccgccagctggtggtgcacggccacttcacggtcgacggcaggaaggtggaccggcccggctaccgcgtgcagcccggtcaggtgatcgaggtgcgcgagtccagccggcagaagccgccgtttcagatcgccgccaccggcgcgcacctcgacgggccgaccgcgccctacctgtccaccgccctggcggagctgcgcaccacggtggtgcgcgtcccgcagcgcaccgaggtgccggtcctctgcgacgaacagctggtcgtcgagtactacgcccgctaactgcgggtctgttccaaccagctggcatagagcttcgcgtaggtcgagccctcctcggccacgagccgggcatgcgggccgcgttgcacgacgcggcccgcgtccaccacgatcacctcgtcggcggcctgggcggtggacagccggtgcgcgatggccaccgtcgtccgcccgcgggtgaccaggtccagcgcgtgctgcaggcgcacctcggtggccggatcgaccgcactggtcgcctcgtccaggacgagcaggtcggggtccgccacgtacgcccggaccagcgccaccagctgccgctcgccgacgctgagcgcctctccgcgctcccccaccggggtttgcaggccggccggcagcccggccaaccagtcgccgagcccgagctcggcgaaggccgcggtgagctgcccgtcggtcagcgacggctcggcgaaccggatgttctccgcgatcgtcgcgtcgaacaggaacccgtcctgcggcaccatcaccacccgcgaccgcagcgacgagaaccgcaccgaggtcagcggcgtaccggagagcagcacccgcccctgcgccggatccatcagccgggtcagcagcttggcgaacgtggtcttgccgctgccggtctcgcccaccaccgcatacttgcgccgggccggcagatccaggtcgacgccggcgagcacgatcggaccgcccggatagcggaacgacacgtcggcgaagcgcaccgacagcggcccggcgggcagttcgacaccgcggtcgtccgggtcggcgacgtccggctcgacgtccagcacgtccaggatgcggcgccagccggccaccgcgttctgcgcctcgttcagcatgtcggtggcgatctgcacgggctggatgaagagcgtgaccaggaacaggaacgcggtcagctgcccgaccgtgagcttcccgtccacgccgagccagaccccggtcaccaccaccccggccagcgccagaccggccccgatctcgccgctggagaagctggtcacgctggtccgcagggctttctgctgggccacccggagcgagtcgatcgaggtgtccagccgggcctgggtgcggccggccaccccgtacgcccggatcaccgtggcgcccacgacgctctccgcgaccgcgcccagcatcacgccggtgcgctcgcgggacgcctgatagaccgcgcgcagccgccgctggaacaggcggctcacccccagggccggcccgaaggcgaggagaaccacaagggccaactgccagctgtacgcgaacatcaccgccgccgacaccagaagctgcccggccgccagcagcagctgcaccccgccggtctgcaggaactgggagatctggtcgacgtcgctggtcacccgggacaccatcgaaccgcgccgctcggactgctggtgcagcatcgacaggtcgtgcacgtgccggaaggtccgcgaccgcagcccgcccagcgcggtctcgctgaccgtgaacagccgccgggtcatcagatagccgcagagcgtcgagatcagcagcgcgcccagggtcagcccgacgatccgcaccacgacaccgacgtccgggccgcccggggcgcgcaccccgtggtcgatgccctgctgcaccgcgatcggcacggccacccgcccggccatctgcagcaacgccaggaccatcgtgccgcccagcccggtccgcagctccggcgagagcgccagcccgcgccggatggtggccagcgtcccctcggcgctcatcgccgctcctcggccttctcgtatgcggtgaccagctcgcgatagccctcgtgcgccgccatcagcccggtgtgcgtcccggtcgccaccacccgcccgcggttcaggtagaccacctcgtcggcgagcgcgatggtggcccgccgatatgccaccaccaggatcgacgcgccggcgtccgccccgcgcagcgcgccgagcacggccgcctccacccgcgggtcgaccgcgctggtcgcgtcgtcgagcaccagcagccgcggcttgccggccagtgcccgggccagggtgagccgctgccgctgcccgccggagagcgacgtgccgcgctcgccgaccggggtgtccagcccggccggcagcccgtcgacgaaccgggcggcctgggccagttccagcgccgtccggacccgcgtgtcgtccacctccggccggtccagggcgatgttgccgcgcaccgtgtcgtcgaagacgaacgggatctgcgggaccagcgcggtggacccggccagcgcggacagcgccaggtcgggaagtttcacgccgtccacggcgaccgtgccggactccgggtcgaccagccggacggcgagcgaggcgatcgtcgacttgcccgagccggtcgcgccgaccagcgccacggtccggccggccgggacggtgaaactcacgtcgtgcaacacctcggggccgtccgcgtaccggtaggagacccggtcgaagcgcagctcggcggggccggtgccgggcagcgtgccctcgccgtacgccaggtcgccctccgcgccgaggaccgcctggacccggtcccaaccggccacgctgcgcggcagctcgcccaccacccagccgatcgcgcgcaccgggaaggccagcacggtgaacaggaacgcgacactgaccaggtcggcgaccccgatcgcgccggaccgcagccgccaggtgccgagcagcagcacggccagcgtgcccaggctgggcaggctgtccatcagcgggtcgaacaggccgcggagccggccgaccgcgatcagcgagtcgcgcagctcgtcgacgaacaccccgaaccggcgggactcgtcggcctcccggcccatcgtcttgaccaccagggcgccgtcgaagctctcgtgcgcgaccgcgctgaccgtggcccggttctgctggacccggatctgccgcggcgacatccgccgggagtagaccaggttgagcccgaacagcgcggggaacagggtggctccgaccagggccagcacccagtcggtgaggaacagcgagaccagcgcgccggccagcatcaccacggtgccgaccgcgaacggcagcggcgcgatcggcgcccaggcggcctccacgtcggagttcgcattggacagcagggtgccggtggcgtgccgctggtgccaggccggcggcagcgacaggtagcgccgggtgaccgcggcccggtaccgcgcctgcagccggaactgcatgtacccggcgccgagccggcggccgaagatgctggccacccgcagcgcgctgacacccaggaagatcgcggcgaccaggccgagccggctagcggtggcccggtgctcggcgaaggcgggcacgacgacatggccgatcacccagccgaccacgtatgagttggcgatgatgagcagcccgaagaggctgctgccgatcgtgccgacggtgaagagccgaggctccgtgcggatcgcgtggccgagcacccgcagaccccgtcccagcacgtcacggctggcgctgctggtcaatttcctacctgactggtaagcattggccggggtttccggccttaccgatcccatcctgccgaaccgcggcccgccagcccaccgtttacattgtggtgacaattacaccggtcaccgcgagcgcgcataccatcggccgatgaacgactacgcccgtcaggaacgccggctcctcgccgacctgctgctgcgcgagggtccggacgcgccgacgctctgcgccggctggaccacccgggatctggccgcccatctggtggtccgggaccgccgtccggacgccggcgccggaatgttcatcccggccctgcacccctacgccgagcgggtgcggacggccaaggccgccctgccctaccccgccctgatcgccgaggtgcgccagcccccggtgtggagcccggtcagcaacccgctgaccgacggcctgaccaacaccctggaattcttcatccaccacgaggacgtccgccgcgccggggcgtcgtgggagccgcgaccgctgcccgccgggcaccaggccgcgctctggcgcagcgtccgactcaccgcccgggtcgccctgcgccgggccggggtgcaggccgaggtgatcgccgacgggttcccgccggtgcgcaccgggccggccccgcaggtccggatcaccggggacgccggcgagctcgccctgttcttctccgggcggcagcgggtcgcgacggtgcggatcgacggcgacccggcgaccgccgaacggttgcggggcgccaggctcggcttctgaattggcccacccggaacggcccggattggctttcccgccgaggccaatccggctctagattcaaggtcatgaccgcccgactctcggtgtcccagggtgccgccctctccatcggcgccgtcctgggcaccggcctgatctcgctgcccgccctggccgccgcggccgccggccccgccgcgctggtcgcctggctcgccctgatcgtcctctccgcgccactggcctggaccttcgccgcgctcggcgcgcgctatccggacggcggcggggtcgccacgtacgccggcatggccttcggccgccgggcgtccgccgcggtgggctggtgcttctacttcgccgttccgctcggcgccccggtcgccgcggccttcaccggcgggtacgtggcgggcgccgtcggcggcggccggaccaccgaattcgtcaccttcctcggggtggtcaccgcgggctacgcgatgaactggttcggcctgcgcgtctccggccgggtccagctggtgctcaccggcaccctggccaccctgctggtggtgaccgtgctggccgcgctcccccacctcgacctcggcaacctgcacccgttcgccccgcacggcctcgccgggatcggctcggccaccgccctgctggtctggggcttcgccggctgggaagcactgtcctcgctgtccgcggaataccggaacccgcgccgcgacgtgccccgggccaccatgctcgcggtcgccgtggtcggcgtgctctacctggcggtggccgcggtcagcgtgctggccctcggtcccgccctggccggcagccgcgcgccgctggccgacctgctggcgatcgggctgggcgggccggtgcgggcgatcaccgcggtggtgtcggtggtgctcaccctcggggcggtgaacgcgtactacgccgggtcgagccggttgggggtggcactggccgcggacggcgccttgccggcccgggtcttcgggggccggcgccgctcgctgaccttcatctacgtggcgagcatcctgtgcgcgctgctgccgctcggactgcgaacctcggcgctgctggtcaccggatgcttcaccctggtgtacgtgttcggcacggccgccgcggtacgcctgctgccgcggggctggtcgcgggcggtggccggggtggcgttcgtggcggtgtgcggactgttctggctgaacgggtggccggcgctgctcagcctggtgttcgcggcgggcgcgctgatctaccgcttcgccgtcgaccgggcggccggccgggccggcaccgtacggtccggcgccggtgccgccgcctcccgtacggacgcgggcgccgggtccgccatcggcgcggcgcctgacacccacccggcgtcgggcgctcgcgcggggtcagagcagttcggccagaagtgccaggccctcgtcgatgagcgcggggtcgacggcgccgaagccgaggacgaggcccggccggtcgccgccgtaccggctcaggtcgtcgaccgctagccctctcttgcccgcgatttcggaaatgtcgggctggtcgcggggcatcagcacggtgacgtgcagccccgcggccgacggcagcacttcacatcccgaaatatcgctcagaagcccggcgatccgggcgtggcgtgccgcgtactcccggcgggcccgccgcacgtgccgggccagctgcccctcgtcgatgaaccgggccagcgccgcctgcatcgccacctgcccgtgcccgtccccgagctgccgggcggcggccagcgcatcccgcagtcccggcggggtcagcacgaaccccgtacggatggtgggcagcatggttttggagaaggtgcccacgtagagcacccgcccgcaccggtcgagggcccgcaggggttcgagcggacggctcccgaaccggaactcactgtcgtagtcgtcctcgacgatcgcgctctgccgccgccgcgcccagtccagcagctgccgccgtcgatccaggctgagaaccgccccgagcggaaactggtgcgacggcgtcacgtagacgatccgcgcgtgcgccggcagccggtcgacgaccagcccggcatcgtccaccggcacgcccaccacccgcgcgccgagcgaggcgaacagcgcccgggccggcggatatcccggctcctccaccgcgaccgtgtccccgggccgcagcagcacccgcccgatcaggtccagcgcgtgctgcaccccgttggtgaccagcacctcatcctcggtgacccggatcgaccgggcgtacccgaggtagcgggcgatcgcggcgcgcagggcgggatgaccgtacgggtcggcgtaggtgcccggcccgttcgcccgcagccgcagctcggcggcgaccatccgccgccaggtgtcgaacgggaacagcgacgcgtccgggatgccgatccggaagtcgtatttcggcgccggcaccgagccgctggtcagcaccggcgcgaaggcccatccggcgcgcggtcgcaacgggtccggcaccgcgcggggcgccggccggggcgtccgggccaccgccacgaacgtgccggccccgacccgggcggtcaggtgcccctcggcggcgagccgttcatacgccccggcgacgctgccccgggacaccccgaggtcggcggcgagcgcccggctggccggcagccggtgcccggcgggcagccgcccgtccgcgatcgccgcccgcaacgcccggtagacggccgcggtcgtccgtccgtcgatgaccagatccacgcctgaacggtatagacaatccggtatacccgtcggtagtaaccgggcgcttacgctcaagcccggaagtcgaagacgaccacccgagggggatgtggcatgaggatccgtcgtggactgttccggacgagcgccctgatggtcctggccgtggccgcggtcagcctgctgagcggcgtgggggtggccctgctcaccggtcccgcggtctcgctgctctgagctccagttcgtccccggagatgaacgagcccgcgcccaccgcacgagtgcacgcgtacgccccggcgatcgtcccgccggtgaggcagtcgccgtcgctcttcccggccgcccatgcggtcaggaaggcggcggcgaacgcgtccccggcaccgttcgtgtcgacgaccggcgcgcccggatcggcggcgtcccggtgcgtccgcccgtcccgggtgtacaggtcggccccgccggcgccgtgggtcaccaccacccgcccggccaccccgtcgcgcaggatccgctcggcggcgcccgcggcgagctgaacgccgctgacgaagaccacgtcggcgcccagggcgaaatcgcgatggtacgggttctccccgtcccagtcgtgcagatcggtcgagacggtgaccccggccgcgcgcagcgacgggatcaggtgccgcgcccagtccatgatcgtcaggtgcacgtgccggaccccggccgggagcggatcgtaataccacgccggcaggcgatatccgggcacgtcccggccgtcgtacagggagagccgccgcccgtccgggctcatcaggttgaccgcccgccgtgtcccggccggggccggcgccgcgtgcagcgggatgtcccactcccggaacgccgccttgacccggccgccgagctcgtcgtcaccgaccgtgtcgaccacccggaccgcgccgccgagcgcccgcagcgccagcgccacgcaggtgccggtgtgcgacacgtgatcctcgatcggcccgcgcgggcgcgccgaatcggcaccgagcaccggcagatccgccaccggtaccacggtgtcgaccccggtcccgccgatcacgagaaaaaccatgccgccacggtagcgactaggattgacccgagttgccggggtgctctagccctgccaccgccatcgcattactctgcggtaacaacgatgttaacgtcccccggttcagtcttaggcggcgcttgatggctctcgaggttccctaccggtcgatcccggacatgcttttccagcgcgtggccaagacgccggacgcgcaggcgttcgccgggccgaacgcgaccgacaccgggatggactggctgacctggcgccaggtgggtgagcggaccagggccatcgcggccggtctgcgcgagctcggcgtcgggctggaggaccgggtcgcgatcctgtccagcacccgcctcgagtggatcctggccgacctcgggatcaacgtggccggcgcggccgccaccacggtctacccgaccaccgagccggaggacaccgcgttcatcgtgtccgactccggttccaaggtgctgatcgcggagaacccgaagcaggcgctgaagatctccggcgcgccgaccgcgatcaccaaggtggtgctgatcgacggcccggccgacgccggcgccaccccgccgcagatcaccctggccgagctggaggagttgggcgcggccgcgctgcgccgcgacccggagctgatcgagcgggtgatcgccgagctcactccggagcacatcgccacgctgatctacacctccggcaccaccggtcggcccaagggcgtcgagctgctgcaccgcggctggacctgggagggtgtcgcacagaacgacctgggcctgttcaacccggacgacctgcactacctgtggctgccgatgtcgcacgcgttcggcaagacgctgctctgcggcatcctgcacgtgggcgtgccgacctacgtcgacggccgggtcgacaagctggtcgacaagctcgcgctgatccgccccacgctgatgtgcgccgccccgcgcatcttcgagaaggtctacaacaagacggtgaccagcggcctggccggcggcggcctgaaagccaagatcttcacctgggcggtggccaccggcaagcgcaaggtcgcgctggagcaggccggcaagccggtcggcgcggtcctctccgcgcagtacgcggtggccgagaaactggtcttcgccaagctccaggagcggctcggcggccggctgcgggtgctggtcagcggctcggccgcactgtcccgggacatcgccgagttcttcgccgcggccaacctgccgatcctggagggctacgggatgaccgaggcctccgcggcgaacttcgtcaaccgcaacggccgcctcaagatcggcacggtgggtgaggcgatcggcgacctggagatccgcatcgacaccgacggcgaggtgctgatgcgcggcgccccggtgatgcgcggttaccacaacctgcccgaggcgacgaaggaggcgttcaccgacgacggcttcctgcgcaccggtgacatcggcgagctcgacgccgacggcttcctgaagatcaccgaccgcaagaaggacctggtcaagacgtccggcggcaagttcatcgcccccagcgccatcgagggcgcgttcaaggcggtctgcccgtacacgtcgcaggcgatcgtcgtcggccagtcccgcaacttcgtcaccatgctgatcaccctggacgaggacgcgatcgccgtctgggccgccgacggcccgctcgccggcaagacgtacgccgagatcgtcgccgcccccgaaacccacaagctggtcgagggctacctggccgagctcaacggcaaactcaaccgctgggagacggtgaagaagttcgccatcctcccccgtgacctgagcatcgaggccggcgagatcacgccgtccatgaagatcaaacgccgcagcgtggagaccaacttcgccgaccagatcgagaagatgtacgagggctcgctcgcccagatctgatcgggaccgctaccgaaaagaccgcttccccaccgggaagcggtctttcctttgccggtacgcggtcagccggcccggtcaggcctccaccggggtgtgctgctcgggggagcgtccggcttccgaggcggccggcgggcgagcggccgatgtcgtccgtcggcgttcaccgaccgtgagcttcggcaggaacaggtggaccagcggcccgatggccagcgcatacgccaccgtgccgacccccaccgtgccgcccagcaggaagccggcgccgaggaccagcagctcgatcgacgtgcggatcacccgcagcgacagccgggggaagcggcgggccagtccggtcatcaggccgtcgcgcgggcccgggcccatccggctgccgatgtagagcccggtcgcgacgccgttgagcacgatgccggcgaccagtaggccgatccgggccggaaggccggacccgggcggcagcacggcgagcacggcgtccgcggagaagccgacgagcagcacgttcgcgatcgtgccgacaccggggcgctgccgcaacgggatccagagcagcagcaccgggatgccgacgagcagcacgatccagccgaactcgatcccggtccgctcggagaggccctggtggaagacgtcccaggggttgaggccgagcccggaccggatcatcagggccatgctggcgccgtagaggaacagaccgagcagcagctgcggcacgcggcgaaccaggttcgtggagagggcggatggtgtgacgcgacgaaccaggctcatgctgccactctcgatgccaattctgcgatgttaaagtgccaatcctcgggaggtggctatgacaacgtcggttcgaggggaccaattggcccggctactcggccggtggcattcactgccgggccggcatcgcagccccgactacgccgccctggccgccgccgtgcgcgggctgctcgccgacgggcggctggcgctcggtgtccgactgccggccgaacgggaactggccgagtcgctcggggtcagccgcaccacggtgtccgcggcataccgcgcgctgcgcgagagcggccacctgaccagccggcgcggtgccggcagctggaccaccctgccgcacgggcaccgggtggccacctccggcctgtggaccccggacgacgacctcgacatgatcgacatgggggtggccgcgtcggccgccccggtcgagctggtcccggccgcccgggccgccgccgacgacctgccccgctatctgggcagcgccggctaccacccgaccggcctgcccgagctgcgcgccgcggtcgccgacatctacaccgcgcgcggcgtgcccacctcggccgagcaggtcctcgtcaccagcggcacgcagcaggccctcgacctggtgctgcggctgtccgttccggccggcgcgccggtgctggtggagacgcccacctatccgaacgcgctggccgccctctccgcccgccgcgcccggatcagcacccacggcatggacaccgccaccggctgggacggcgagatgctcctcggcgcgctgcgccagacccggccgcggctcgcctacctgatcccggaattccacaacccgaccggccacctgatgcccgccgagctgcgcgagcgcctggtcgccacggcccactcgaccggcaccgagctggtcgccgacgaatccttcgtcgacctgccgctggacgacccggcgatgccgccaccggtcgcggtcttcgaccggcactcccgggtgatgtcgatcggcggaatgagcaagccctactggggcggcctgcggatcggctgggtccgcgcctccgccccgatggtccagcggctggccgcgatccgggtcggcgtcgacatggccagcccggtcctcgaacaactcgtcgccgtccacctgttgcgactcgctccggaaatcgtcgcggcccgccgggcccagctgcgcttccgccgcgacgccctggtcacggcgctccgcgaacagctgccggagtggcggttcttcgtccccggcggcggcgtcaccctctgggtggagatggacgggccgatctccagcgccctgtcccgggccgccgaggacgtcggcgtgcgcctggcgcccggcccgcgcttcggactggacggcacgctggaacgcttcctgcggctgccgttcaccctgccggccgacgacctgacggaagcggtccgccggatcgcctcggtccgccacgacctcgaccgcaccccacgacccacctggcgcaccccggccgtcatcgcctgatcggttgccgtcctcgcccatttcggtgaccacaaagccgttcgcgcacggtttgaggcgccccgcggggggatcgccggttcgaccgggatgaccgggcttcacaccggccggcggacggtcatcacggcgaatacgcgaggcgcttgccgaagtcccgggcgggcatcgacggttcccttgaacactgccggccctcttggtcgcttgccgaagtcccgggcgggcgtcgacggttcccatgaacactgccggccctcttgagcactcgccgatgttcctggcaggcatcggcgccggccgaagctcccgggcgagccgcggcacttgccgcagtccccggcgagcttcggccgctccggaccggggcacctcgccgggcggagcgcggtcaggaagcggcgccctggtgcaggccgaagaggttgccgtcggcgtcgcggaacgtggcgatcagcgtgccgccgccgacgtcgtggaccgggcgttcctcggtgccgccgcccgcgatcagcgcggtgagttcggcgttgatgtcgtcgacgtgccagtagacgatcggcccggcggcgacgtcaccgtgcgggtcgagtcccagctcggggccaccgtcgggacggaatccgacgtagtacggcgcgtcggcgtagggttcgacgccgagcagccgggtgtacagagccctggccgcgtccaggtccttgaccgggacggtgatcgttcgaataggcatttttcccccgatgtcacgctcgatcttctgtcagaaaccgtatgccggaagcgcgggcacggatgtgccgatgcgcgaataccccggtttccggaggcggccgtcgatggcggagatcaggaatatcaagatcaaattcatcatgtcgtacgctgcggccgacgactggtcgtgcgcggcaggcgcgcgggatggttcggtgcccgcacggtgagataggggtaccccgatgtacggcgtatgtcgttatcaagtgtgaagatcaccttttatcccccgcaaccacccggtgatcatccggacacattcgcttcccgacatgccggcggcacggcatcattgcggcatgggggccggcggctggaattggaacgacgcgtggatcttcgtctccgcggtcatcgctgagcgtctggagcgtgaccgcgcgctgcacgccgccctgccggtgaccggcgccacgctcgccgacctgatcgccgcggccgacttcctgcaccacagcgtgccggcccgcgccgagctggaggagtcggtgcgccggctggccggcgccggcctgatcacggtggccgacgacatcgtccaggtcgccccggccggcgagcagctctggcgcacccgcccgttcagcggcctctcctcagcggtgatgaccttgcagacccagctgaaccgcgccgcctcccccggacggagcgagtggaccctggaggagtccacctacaacgccgccgtccgcgagtacagcctccgcctcgccgacggccgctgagcgagccgccgccacaccccgcgaacccggccacgcgccgacctcgctcaacccgatcaacgcaccgcaccgcgcacggaccccactggtcccggtcagcgaaaccccgtcccgcgcagaccccgctcggccgagtcagcgcaccgcgttgcccgcatcccggagcgacgtcttgacctcgccgatcgtcaggtcaccgaagtggaagacgctggccgccagcaccgcgtccgcccccgccgccaccgccggcgggaagtgctccaccgccccggctcccccgctggcgatcaccggaatgtccaccacggcccgcaccgcccggatcagctccaggtcgaagccggctttggtgccgtcggcgtccatcgagttgagcaggatctcgccggcgccgagttcggccacccgggccgcccactcgaccgcgtcgaggccggcgctgcggcgcccgccgtgggtggtgacctcccacccggacggctgacccgcggcccggcgcacgtcgagggacagcaccagcacctggttgccgaaccgctccgcgatctcgctgatcagctcgggccggttgatcgccgcggtgttcaccccgaccttgtcggcgccggcgcgcagcagcacgtccacgttcgccaccgaccgcacaccgccgcccacggtcagcgggatgaagacggattcggcggtacgccgtaccacgtcgagcatcgtcccacggtcgtcggacgacgcggtgacgtcgagaaaggtgagctcgtcggcccccgccgcgtcgtaggcggcggcgagttcgacggggtcgccggcgtcccggaggtcgacgaagttgacccctttcaccacccgtccggcatccacgtccaggcaggggatcacacgcaccgcgaccgtcatgcccccaccctaaccagccgttccacgccactcgaacgggtcatgcccggtcccggaaacgtgccccaccgggacgccggcggggcacgctccgatctcaggcccgggcgagcacgtccagcgcctcgcgcacggtgaaggcgccggcgtacagcgacttgcccgcgatcacgccctccaccccgatcggctccagggtcgccagggcgcgcaggtcgtccagggtggagacaccgccgctcgcgatgaccggcttgtcggtggcggcgcagacctcgcggagcaggtcgaggttcggaccacgcatggtgccgtccttggtgatgtcggtgaccacgtatcgcgcggcgccggccttgtcgaggcgggtgaggacctcgtagaggtcgccgccgtcgcgggtccagccgcgggcggacagggtccggccgcgcacgtcgaggccgatcgcgacccggtcgccgtattcgccgcagatgcggtcgcaccactccgggtcctccagcgcggcggtgccgatgttgacccgctgggcgccggtggccagggcgcgggtcagcgattcgtcgtcacggatgccgccggagagctccactttgacgtcgagccgggcgacgacgccggcgagcaggtcggcgttcgagccgcgaccgaaggcggcgtccagatcgaccaggtggatccactcggcgccgtcgttctgccaggccagggcggcctccagcggatcgccgtaggcggtctccgagccggcggcgccctggaccaggcggaccgcctggccgtcggcgacatcgacggcgggcagcagttgaagcgtcacgtttctccctaggaacggcggcccagcgccacgacgaccatggccggcgcggcgaggacgatcagaacggtgagcaggatgcgcagcgccgggtcggggatgaggatccagaccgcggcgatggcgatcagcgggaccagcacgatgccgatccgctgccgccgactgcgatggtagagacggccgtcgctgccgagtctcggcagccggagccggttgagcagagcgcggcgacgctgccgccgggccaccttccgagcccgggcggccttctcgcgttcgaggacgacgagccgttcggctcggcgtcgcgcgcgttccttgctcatcggagcgcggtgacccagttgctcagcagcgcgaagccggcgtcagccgatttctccgggtggaactgggcgacgctgagcgcaccccgctcgaccaccgccgcgaacggctcgtcgtgtgccgcggtggtcaccgcggcgtcgccgagcgcgccgaggtcctgggccgcgtacgagtgcacgaagtagaaccgggtgtccgcggccagcccggccagcagccgcgacccggccggcacggtgaccgtgttccaccccatgtgcgggatccgcgcggcgtgcagccgggtgaccgagccgggcagcagcccgaggcccttggtctgcaccccgtgctccaccccggactcgaacatgatctgcatgccgacgcagatgcccagcaccggccggccctgcgcgatgcgtccggcgatcaccgggccggcgcccaggtcgtcgatgccggccatgcacgcggcgtaggcgccgacgccgggcacgaccagcccgtcggcctcggcggccagcgtcaggtcactggtcaccgtcacgtcggcaccggtgcgggcgacggcccgctcggcgctgcgcaggtttcccgatccgtagtcgaggatcaccacccgggccgccatgtcagagcacgcccttggtggacggcagcgagccggcgttgcgcgggtcgatctcgacggcctcgcgcagcgcccgggagaacgccttgaactgggcctcgaccacgtgatgcgcgtcggggtggccgcccggccggcaggcgcgcagcacgtcgacatgcagggtgaccttggccgcgtgcccgaacgcctcgaagatgtgtcgggtcatgctggtcgcgtagaccggcccgatgtacggcgtgagcagcggctcgtcgtgcaccacgtagggccggccggacaggtcgacggccgcgcggacgagcacctcgtccatcgggatggtggccgatccgtaccgccggatgccccgcttgtcgccgagcgcctgcgcgaaggcctcgcccagcgcgatcgcggtgtcctccatggtgtggtgcgcgtcgatctccaggtcgccctcggtgcgcaccagcaggtcgaatccgccgtgcttggcgagctggttgagcatgtggtcgtagaagccgacgccggtgctcaggtcacccttgccggtgccgtcgaggtcgatctcgacgagcaccttggtctcgttggtgacgcggtcgatccgtccggtgcgggtcacgacaagatctcctcagcggcgttcaggaaggcggtggtctcggtctcggtgccggcggtgacccgcagccagccgggcaggcccacgtcgcggatcagcaccccgcggtcgaggaaccgctgccaggcggctctctggtcctggtcgccggtggcgaacagcacgaagttggcgtcgctgtcggcgacccggacgccccgggaccgcagcgtggccacgatccggtcgcgctgctccttgatcgcctcgacggtggccagcagcgacgcgcggtgcaccacggcggcgcgggcggcggcctggctgatcgcggagagatggtacggaaggcggaccagctgcaccgcgtcgatcaccgccgggtcggcggccaggtagccgaggcggccgccggcgaagccgaacgccttgctcatggtgcggctgatcaccagacgcgggtgcccgggcagcagggtgagcgcgctcggggtgccggggcgcgcgaattcggtgtacgcctcgtcgacgaccaccatgccgcgggccacgccgaggatcgcctcgagcacggccgggtccagcgtggtcccggtcggattgttcggtgagcagacgaagaccaggtcggggtcgtgccgccggatctcggcgacggcccgctccgggtcgaggccgaagtcggggtcgcgcagcgcgccgatccacccggtgccggtcccctgcgcgagcagcgggtgcatcgagtaggacgggccgaagccgagcgcggtgcgccccgggccgccgaacgcctgcaggatctgctgctggacctcgttggagccgttggcggcccacacgttggccatggtgagcccgtggccgaggtaggccgcgagctcggtgcgcagggcgatcacgtcgcggtccggatagcggttgaggtcgtgcagctcggcctggacggccttggcgatcgcctcggccacatcggcgggcaccgggtacgagttctcgttggtgttcagccggaccgggacgtcgagctggggcgcgccgtagggcgacttgccccgcaggtcgtcgcggatcggcagatcgtcgatggtggtcaccggccgaacctcgcggtgaccgcttcgccgtgggccggcaggtcctccgcgttggccagcgccaccacgtggccggcgacgtcgcgcagggcggcctggtcgtattcgacgacgtggatgccgcgcaggaacgactgcaccgacaacccggacgagtgccgggcgcagcccccggtcggcagcacgtggttggaaccggcggcgtagtcgccgagcgacaccggggaccaggcgcccacgaagatcgcgccggcgttgcggacccgcagggcccactcccgcgcgtcccgggtctggatctccaggtgctcggccgcgtaggcgtccacgacggccaggccctgctccaggtcgtcgaccagcaccacgccggactgctcgccggtgagcgcgatccgcacccgctcggcgtgcttggtcgcggggacccgggcggcgagctcggcgtcgaccgcgtcggcgagcgccgtcgagtcggtgaccagcacgctggccgccagcgggtcgtgctcggcctggctgatcaggtcggccgccacgtgccgcgggtcggcggtctcgtcggccaggatggcgatctcggtggggccggcctcggcgtcgatgccgaccgtgccgcgcagcagccgcttggccgcggtgacccagatgttgcccggcccggtgatcacgtcgaccggctcgcagcggtcacccgcgtccaccccgtccgccccgtagcccagcatggcgatcgcctgggcgccgccgaccgcgtagacctcggtgacgccgagcagggcgcaggcggcgagcacccgggagtcgggcaggccgccgttgtccgcctgcggcgggctggccaccaccagaccctcgacgccggcctcctgggcgggcaccacgttcatgaccacggtggacgggtagaccgcgagaccgccggggacgtagagcccgacccggcggaccgggacccagcgctcggtgaccgtgccgccgtcgaccaccttggtggtggtgtcggtgcggcgctggtcggcgtgcaccttccgggcccgcctgatcgcctccagcagggcggcgcgcacggcggggtcgagggtgtcggcggccgcggtgatcgcctcggcgggcacccgcaggcgctccagggtgaccccgtcgaaccgctcggtcgcctcgcggatcgcactgaacccatgctgatggaccgcctcgacgacgggacgaatcctctcgacggccacggagacgtcgagctgggcacggggcagcagaccgcgcgggtccgggcgggagccgcgcaggtcgatccgattcagcacccgaccagtctaggcggcccctccgacaactccgcgggcgcgactccccggcccaggcgttgggaaaacacaggtttgcccaaggtcagccgacagctaggctgaacccgtgagcgatcggctgccggtcttcccgctgagcacggtgctcttccccggtctggtcctgcccctgcacatcttcgaggagcgttatcgcgctctggtgcgggagctgtcggcccgcccggccgagccgccggctgagttcggcgtggtcaccctgcggcacggcagcgaggtggcggaggggttcggcgacggcccggtgcccgatccggccccggtcggcgccggtgatctcttcgaggtgggctgcaccgccgagctgcggcacgtgagcgagctgccggacggccggttcgacatcatgacggtcggtcgccgccggttccgggtgctcgccgtcgagcagggcaccgagccctatctgtgcgcccgggtcgagtggctgcccgcggaggacatccccgacccggccgccgacctgctgcggccccgggtgctggcggccttccagcgttatctgacgctgctgcggccgagcgccgacatcctggaccagatgccggaggacgcgaccgtgctgtcccacctggtcgcggcgaccgcccagctcaccgtcgaggagcggcacgcgctgctggccgccacggacaccgtcgcccggctgcgcgccgagctgcggctgctcaaccgcgaggctggtctgctggcccgggtgcgggcggtgccggtgccgctgtcggatctggcgcgcccggcgagtccgaactgagctgttgcgccctgaacggcgccgagccgggcggctccgcctcgtactgcccgtggttggggccgtaaccgggctgtgcacccggactgtccaggtccgggtcgttggaccagccggccagcagggtcagcacgatcgccgcgacgaacgccgcgaccagcgtcgggccgtgcgcgtggatctgcggcggggccaggtaggtgtcgcctttcgcggcggtcgccttccagtgggtgtagtcggctcggccgatcatctgaccgagcgggaccgccacccagcggatcccggcggcggcgccggcgacgacgcccagcagcagtgccggcccccgatcgcggcgcagcaccagccaggcgagcaccgccaccagcaggccgaagccgaggccgagcagggtcagccagccatcggcggcgatgaactgctcggccgggtcggtgaccaggaaaccggaggagccggcgtcgaccacctccacgcgtggcgccagcgtgtgccagagcagcccgaccggggcgccgagcgcggcgatcacggcggcactgcccaggccggtggcgagcgtgcggcgcagcgaacggtggctgccgccgcgctgcggacgccaccaggacggtcccgcgggtggctggtcgacgatcacggagtcctctggctgcactctctgatccttccagatcgggccggggatcaggccaccgccgccgggccgaggatcatcttgaggtcggcgcgcagcgcgggggtggccgcgacccgggccgcgaccagccgcaccaccgtggtccgcttgccgttctgcaggtggacgtgcacctcggtgtcgccggggtggctgaccaggatgtccttgagctcgtcgacgagcggcggggtgaccctggtgatcggcatggtgaggaccaccggcttgctgtccgggttatgggatatatcgggaatggacatgtccatcgccatgatccgcggggtgtcgtcgcgccggtcgacccggcccttgaccaccacgatcgcgtcctcggcgatgtactgcccgatcagctcgtacgtgttcgggaagaacagcgtctcgaccccaccggccaggtcctccacggtggccgacgcccaggcccggccctgcttggtgatccggcgctgcaccccggtgaggatgcccgcgatggtgaccacctggccgtcctgcaccgaaccgtcctcgttgagcgcggcgatgctgatgtccgcgttgctctgcagcacctgctccagcccggccaggggatggtcggagacgtagagaccgagcatctcccgctcgaaggttagcttgtcgcgcttgtcccactcactgtccggaatggtgggcatcgccacggtcgccgacgacccggcgctgtccccgaacgcgccgaacaggtcgaactggccggccgcctcgttccgcttgaccccggcgtacgcgtcgatcgcctcggcgtgcacggcgagcagccccttgcgggagtggcccatcgagtcgaacgccccggccttgatcagcgattcgatggtccgcttgttgcaggccaccgcgtccaccttggacaggaagtcgtagaagtcggtgtactcgcccttctccttgcggcaccgggcgatcgcctcgaccacgttgccgccgacgttgcggaccgcgcccagaccgaaccggatgtcccggcccaccggggtgaacgggccggccgactggttcacgtccggcggcagcacctggatacccatccggcgacactcggccagatagacggccatcttgtccttgtcgtcgccgacactggtcagcagcccggccatgtactccgccgggtagtgcgccttcaggtacgccgtccagtaggagaccaggccgtacgccgcggagtgcgccttgttgaacgcatagccggcgaacggcaccagcacgtcccacaccgcctggatcgcctcgtcggagtagccgtgctcgcggcagccgtcgcggaacgggatgaactccttgtcgaggatctccttcttcttcttgcccatcgcgcggcgcagcaggtcggcctggccgagcgagtagccggcgaggatctgcgcggcgcgctgcacctgctcctgatagacgatcaggccgtaggtgggctccaggatctcgcgcagcggctcctccagctccgggtggatcggggtgatctcctggagtctgttcttgcgcagcgcgtagttggtgtgcgagtcgacgcccatcgggccgggccggtacagcgccagcacggccgagatgtcctcgaagttgtccggtttcatcagccgcagcagcgagcgcatcgggccgccgtcgagctggaacacaccgagggtgtcaccgcgggcgagcaactcgtacgccggcttgtcgtccagcggcagggccagcaggtcgagcggggcgccgtggttgagctcgatgttcttgttggcgtcgtcgatgatcgtcaggttgcgcaggcccaggaagtccatcttgagcaggccgagcgtctcgcaggtcgggtagtcgaactgcgtgatgatcacgccgtccgaggcccggcgcatcagcgggatgtggtcgatgatcggctcggcggacatgatcacgccggccgcgtgcacgccggtctgccggatcaggccctcgatcccgcgcgcggtgtcgatcaccttcttgacgtccgggtcggtctcgtacagctgacggatctcgccggcctcgttgtaccgcttgtgttccttgtcgaagatgccggagagcgggatgcccttgcccatcacgtccggcggcatcgccttggtgatccggtcgccgaccgcgaacgggtagcccagcacccgggccgagtccttgatcgcggccttcgccttgatcgtgccgaacgtggcgatctgggcgaccttgtcgtccccccacttctcggtgacgtagcggatcacctcggcccgccggcgctcgtcgaagtcgatgtcgacgtcgggcatcgaaatgcgctccgggttcaggaagcgctcgaagatcaggccgtgcggcagcggatcgaggtcggtgatgcccatggcgtacgcgatcagcgaccccgccgcggacccgcgccccgggccgaccgcgatcccgttgttcttcgcccactggatgaagtcggcgaccaccaggaagtacgccgggaagcccatgctgatgatcacaccgagctcgtactcggcctgcgtgacgtgggtgtccgggatgccggccgggaaccgcttgcgcagcccctcgaacgccacgtgccggaagtactcctcctcggagaagccgtccgggatggggaaccggggcatcaggttcttgaacgtgaacatcccctcgatgtccaccttctcggcgaccagcagggtgttgcggcagccctgctgccaggcctcggaggagtccaccgcgcgcatctgctcggccgacttcacgaagtagccgttgccgtcgaaccggaacctgttcgggtcggcgatgttgctgccggtctgcacgcacagcagcacgtcgtgcgcctcggcctgggcctcgaaggtgtagtgcgagtcgttggtgaccaggggcgggatgttgagtttccggccgatctccagcaggccgtcgcggacccgcttctcgatcgacaggccgtggtccatgatctcgaggaagtagtagtccttaccgagggcctcctgatacatcgcggccgacttcagtgcctcgtcgaactggccgagccgcagccgggtctgcacggcgccggacgggcagccggtggtgcccatgatgccctcggcgtgctcggcgatgatgtcgaagtccatccgcgggtatttaccgagctggccctcgatggaggcccgcgagttcagccggaacaggttcttcagcccgaccgcgttgcgtgcccacatcgtcatgtgggtatacgcaccgttaccggagatgtcgtccgatttctgctccgggcggccccacttgatccggctcttgttcagccgcgaatccggggcgacataggcctcgacgccgatcagcggggtgatcccggccgccttggactgcgtgtacatctcgtaggcgccgtgcatgttgccgtggtcggtgatcgcggcggccggcatgccgagccgtttcgcctcactgatgagttccttgacccgggccgctccgtcgagcattgaatactctgtgtgaacgtgcaggtgcacgaaggagtctgacacccgggccccctcttctgttggcgaggcggatcagcttactccgcgaagggctccagcatcaccgacgcggcccgcaaccacgcctgccgggtctccggttgcagatcgccgtactcgatcgacgaacccacctccagcgccgggtcgtagggcaccaccgcgaccgcgcgggtgcgggtcgcgaagtgcttcttgaagtccgccagcagcggcagggctcccggcgaggggcaggagatcagcgtcacggcgttggccaccatgtcgcccatcccgctctcctccagcacgtcgagcatccagtcggcggtgaacgcggcgtcctcccggggcaccgtggtgatcaccagctggtcggccatccgcatgaccgtctgccagttcacgctctccacgttgttgccggtgtccacacagatcacgtcgtgggtgcggcgcagcaggtcggtcacccggcgcacggtgccctggtccagccgctgggcgaagcgcgggttctcctcgccggcgagcacgtcgtaggacccgtcggaggcgtgccgcaggtacgcgtcgagctcctgcagcagcgcgtcgccgtgcaggccctcgatccggtccaggtcggcgagcaggtgcttgatcgtccgggcgtgccgggcgctgccggcccgcaggccgagcgtgccgcgcagctcgttgtcgtcccaggcgagcacgccgcggccgcggacgctgccgatggtggccgcggccagcacggtcgcggtggtcttgtggacgccgcccttagggttggcgaaggccagcacgcgcggcttgccgagcgtgcggcgcagcaccgcggccgagcggtccagaccctcgtcggtgcgggtctgccgccactcgatccgggcaccgaccccggcggcgggtgcgagcggcgccggcggggcgagggacgccggcggaggcggggcgaccggcggcgcgagcggcggctagctagctagcataggcgtgcggggcggccgggggctgcccgtagccgttggtcgcgggatgaccgttcggctgcggcacctgaggcggatagccgggcgccggcggatagtcagcccgtgcgggcggtgcgggcggcggggtgaccggctgcggcgaccgcggcgccggctcgaagaagctgtgctgctgctggtccgggcgggcctgccagcgcggatcgagggggttgaccggccgctgcggcatcggccgctgcggttccgcggccccgtacctcggctcggcctggcgctggccctcgtaaccccggttctccagcgggttcaccggccgggccgacgcccgggtcggcggcgccggcggctgctgctgcccccactgctgcggcaccgcggccggatcggcccgcggctcgtccgccggctcctcggcgcggtgaccgtgccgggcccggtcgagcagggcccgccagcgcggggccggctccgcaggccggccccagccggtctcggtcccgtccacggcgtgtcctttctgcgcctacccgacgtcgtgctccggcgagggggtctcgccaagacaggctacggaggcaaaccctatgcgggccaccgaccgactgcccatccccccgtcgttcttgatcacatgacggcacgccggtcgtgcacgtgcatccacccgaacgtttcttgatacggaaaaatcagcggccgggttcggcgatcgacgcgacggatgaggcctgagctgtgcccacttcgtcctccgagggtacgtcagccggagccgtcgacgagacggcgaccgagggtgaccggccgggaccacgcccggatgagtgggaagtcacagtgcctccgatcgacgacggtaaccgtccgggcgatccggaggcaacgcccggtgtcgcggttggcacaggccgcaccgacgggtccgcggtcaccaggccgctctcctcgggccgcggcggccggaactcggtgtggtccaggctgcgcacctcgggagccgggtcgacaccgcgcacccccggccgggacgcgatgccgcccagggtcgccggtgcggcgcggatcacggccgcgaagacacaggagcagccggcccggtacgccgcggcctcctgcgccgcgaccagagcggccgtgccgtacgtggtgcgcagccgctgctcgcgctgcccctcgccggtcagcgagcgttccagccgggacaggtcggcctgctcccggtcgcgcaccagggccgcgtcgagcatcccggcggtcacgtccccgggcatcgagtagaccgggatcagcgacacctgggtgcgcaccccgggcagcggcacccgcgcgtacacctgggccaccgtcgcgcccgccagcagcgccggcagctgggccggcgcggtgtagtcgcggaggctgaccagcgcccaggtgtccccggcggccgggccggacgggtcggtgagcatgctgagctcacgccgcgaggagtccaggtaaccgccgaccgtctggccctcgatcaccccgacccgcaccacgtcacccgggtcgccgccggacgggtcgccggagtggccggcccaggcgacggcgagcaccagcgtcgcggtggcggcggccgccaccccggtcatgatctgcaaccggagcgagccgcccccgaacctgacgaggaccgctcgcacacgatgcgcgggccccacggcgtctcccggatgtcagcaggtcagccggcgtcctgcaggacgtccagcgcgaatttcaggtcgtcagggtagtcgctgacgaagcggacctcatcatgcgtccgggggtgcaggaagcccagttcccgggcgtgcagccactgccggttcagcttcagccgggcggccagggtcggatccgcaccgtaggtgagatcgccgacgcaagggtgccgcagcgccgagaagtgcacccggatctggtgggtacgcccggtctccagcttcacgtcgaccaggctggcggcgcggaacgcctccagtgtgtcgtagtgggtgacgctcggcttgccgccggacatcaccgcgaaccggtagtcggccgtcgggtgtcggtcgatcggcgcgtccacggtgccgcgcagcgggtccaggtgtccctgcaccaccgcgtggtaccgcttgtccacctcgcgctccttgaacgcccgcttgagcacgctgtacgccatctcggacttggcgaccaccatcaggccggtggtgccgacgtcgaggcggtgcacgatgccctggcgctcggcggcgccgctggtcgccacgttctgccccatcgcggccagaccgctgaccacggtcggaccggtccagccggggctcgggtgggcggccacgccgaccggcttgtccaccaccacgatgtcgtcgtcgctgtagatcaccgacaggccgtgcaccggctgggcgaccagcaccggagcagtcaccggccgcggcagggtcacctccagccaggaacccgcggcgaccttgtccgatttcggccggggggcgccgtcgaccagcgcgtccccggattcgaccaggtcggccgcggccgtgcgggacagcccgaacagccgggacaccgcctggtccagccgcatcccgtccagcccgtccgggacgggcagcgaacgcgtgtcgctcacgccgtctcctcggtctcgacctgctcgttcttcgtgttcttcagccggctgccgtcccgctgccggccggtgagctccagaagcaccgcgaggcagacgcccacggtcaggcagctgtccgcgatgttgaacaccgggaacttctccgcgtacggcgcgaacacactgatcatgtcgaccaccttgccctggaacgggccgggtgcccggaacagccggtcggccaggttgcccagcgcaccgccgagcaccagaccgagagcgagcgcccacggcaccgaacgcagccgggtcgccatccagccgatccagccgatcaccaccagggtgatcaccgggaagatccaggtgtgcgtgtcgccgaagctgaacgccgccccgctgttgcgcagcagggacaggtagatcaggccaccgaggatccggaccggctcgttcgggtcgagatgctcggtggagaggtacttcacccactggtcgagcgccagcgccagcagcgcggtggcacccagcaccgcgacggcgcgcgcggcgaaccggggagccttgtcggcgttcagcgtcgttcctccagttgcttgcatgacacacagagagtcgcggacgggaaggcggcaatccgctccaccgggatctggttgccgcaccgctcgcaccaaccgtagttgccctgtccgagccggtcgatggcgcgttccacctgtgtgatccgctcgagcagattgttggccagcgtgatctcctgctcgcgctcgaacgtcttggtgccggtgtcggcctggtcgtccccggccgagtcggcgagccgctcccgcgaaagctcggtgatctcactgagcgcatgatcgtactcggcctgcagctcggtgagccgcgccaccagagcctcccggatctcggcggtctcggcctcgctgcgctgccgctcgccggccgcgtggccgcccgaggcgggccggatgtcggttgccttggccatcgtcgctccctcggccgcgcccggcgcggcggtcagcggtcctctttccaccgggttacccgtcccgccggccgcttaccctccggccgccggaccccggtagatcttgccccacctgcagaaatggcgcggctggaaagacgccgcgcactccggagggtggcaacgatacggaaagtgagatgacccgacaacccgccgggcagccccattcccgacaaacggcatgaaacagccagccggcgatcggatacccgacgatacaccccaggtcaccccggcatcaccggttgtcactctccccggcgcctgaatccggccgccctacctctcggccaccagtgcggccaagagcccggccacctccgcggccggcgcatccaccgtgaagaccttgtcccggctcgtcgcaccgacccgcaggctcaccgcggcggcccgcacccccaacgcggcggccagcgcccgccgggccgcctcggtcgcgtggccgtcgaccgcgggcgccgccaccgcgatgatcaccgccgtcccgtgcgggccggggtagccgccgccgacccgggtccgcccggctcccggccgcacccgaaccggcactgacaccatcggcggtcagcggcgcgcgttcgcgcccagcagccggtccaccggccggcacaggccgcacgggctgaagccgagctccaccgcctcggccgccggcaggggctcggtcagccgcccgaccaggtgggggcagtccgccatgtggtagcggggccgcccgtccaccacgagcacctcggtgtcgaaccgggccacctgcacggcgtcggcggggcgcaccgcctgcggcagcggttcgtcgtccggatcgtcggcgtccggttccccgaacccgtcgtcgagcccggcgtcggtggccatcggccgccgccacgactggtcgtcgtcgtgtccgccgcgggccgccccgatggtcgacgacgcggcctgatagtcggccgcgggcaccggcgttacgacggtttcgtccgggaggtgtgttcccgcggcacccgcgtcatcggtcgccggcggaagatcgaccggctcgccgtgatccgccgcggcccgctgctcgtatacctggccacccgccggcggctccggggcggtgggcggggcggaggcgaaggtgggcggctcggcgtaccgcgaatcggctgcgaacgcgtcgccggccggggcagaatcgtgggcgtcggacggcgccccggtggtgcggcgcggagccggcggcggcgggaagtcgtcgtccggtgactccggacggtgcgccgcggcattgcgccgcgcgccgatgacgagggcgaccgcggccagcaggctggccacgatcgacgctatgagaaggctgctcgacccgcggaccaggccgatcgcgaggcacaccaccgcgacgaggatgagcgggaaactagcagggatcatggctcatcctcgtcgtggtgcggggctgcgtcagcggcccgtttcgatggcgttcgaccggccgccgtacgacccggccaggccggccgcggcgaggccgccggaaccgccgaccgcacggctcgcgtcggcgcgcgccatctcggcctccaggccctgaccacgaccgtcgaggtcgcgcagctggctctccaggtacgccttcagccgcgtgcggtactcccgctcgaactgcttcagctcctcgatgtgcttctgcagcgcggtccgcttggcgtccaggccgcccatggcctcctggtgccgctggcgcgcgtcgcgctcgagggcatcggccttggcccgggcctcccgggtgacctcctccgccttggagcgggcgtcggagagcagcttgtcggcctcgcggcgggcgtcggacacgtggtcgtcggcggtgcgctgggccatcatcagcacccgcagcgcctgctgctcgccgtcggcgccggtcgggccggcacccgggccggggccctgggcacgcacctgctccagctcggcctgcatctgccgggccgcctgctcggccgccgtcttgtcccgctggacgcggtcaagctggcctttcaggtcgttgagctcggccgcgaggcgggggtcggcgctcgggccggctggtgcgccaccccggccgccgcgctccacctgggcgcgcagctcgttgttctcctcgatcagacgggcgagctcgcgctcgacctcgtccaggaaggcgtcgacctcctcctcgtcgtacccccgcttgccgatcgggggcttcttgaaggcgacgttatgcacgtcggccggggtcagcggcatcgaaactcctcgggtcagtcgcggccgcggttggggctgctgtctatctgtagttcaagatgagctgaaggagcactaactgcatgagcacgaacaggataaccagcagcacgatggaagccaggtccaaactcacgttaccaatgcgcagcggtgggatcacacgcctcaacgccttcaaaggcggatccgtgacgctccacaccacctcgagtgcggcggacgcgccccggcccggctgccatcggcgtccgtactggagcaccgcacccaggacgaacctgctcagcagcaccaggaagaagaagtaaaccaacagatagagaatctggaacacgatcgacagcacgtccggcggatccctcgttcgggtcaactctgggcgaagaacccgccctcagcgatcttggccttgtcctccgcggtgacctggacattcgccggtgagagcaggaatacccggttggtcacgcgctcgatcgtaccccgcaggccgaaagccagcccggcggcgaagtccaccagtcggcgagcgtccgattcatccatctcggtgagattgatgatgaccggcgtgccgtcccggaagtgctcgccgatggtccgcgcctcgcggtacgtggtggggtgcagcgtggtgatctgataccgctgctcgtcctcgatcggacgctgctgcacctgcggctggtgcaccggctgcggggcgagcgcgaggttctcccgggtggagtaggtgagcgccgagggctgctcgggcgccaccgcggccggccgggtgatcgagcgcacgctggaccgctcgatccggtcctcgtcgtcccggtcgagctcggcgcgcaccgaggaggcgcggtcgctgagccgggacgtgcgctcggtgcgctcggagcggaccggacgccggggcgcgggccgctcgtcctcctcctcgtcgtcgaagtcgccggagtagcggtcgccggacgagtagcggtcctggtcgcgatcgtgccgatcggaccgcgacgaccggtaggagctctcgcggtatccccgctcctcgtagtcgcgctcgtcctcctcctcggcaagacccagccagacggccgccttacggaaagtactcatagcccccacctccgtccgctgttgcggcccgcgccccctcatggcgtgccgcgtcccccctggcgagccggacaccgggtccgttacggaccggcggcctgctgcgacgctgcgtcgtcggacgcaacggccgccggtggtggcgcgtcgcgtaaaacaacacctgtgtagtttgctgcccgccgcaaggctaccgcagcgagtttcgcatcccgagtaaagatgtaccgatccgtacgtgtgtcgccccgtgccggatcgccgcctccaggtcgccactcatgcccgcggacagcgtggtggccccgggatgcgtgctgaccagggcaccggccagctcggccagccgggcgaaggcccggtcgggatcctcgcctagcggtgcgaccgccatcagcccgccgagccggagaccgtccgacgccgccaccgcgtcggatacccgccagagatcatccccactcgcgccgccgcgctggggatcgccgtccaggctgacctggaccagcacctccagcggggaatcgcggaccgccacggcggcccggtccagcgccgtcaccaggcgcaccgaatccacggactcgacgacatcggcgtacgaggcaaccgatttggccttgttccgttgcagttggccgacgaagtgccagcgcagggcgaccccggcggcccgcgcctcggcagccttgccggccgcctcctgatccttgttctccccggcgtcggtcacgccgagcccggcgagcaacagcacgtcactcgccggatacgtcttggtcaccgcggtcagcgtgaccgccccgggcggccgtccggccgccacccgggcacgctcgatccgctcccgcaccgcacgcagattggcggcgagctcggcccgccgcccctcgtcgaactccatgagtcgggatcaggacccgttcttcaggaagtcgggcacgtccacgtcgtcgaacaggatctgcttgcgcggcgccggcgtggccggggcggacggcgcctggtgcggggtcagcgaggtcgagctgaccggcgccgagctgcgcggctcggcctgcgggagcaccttgttgcgcaccgtctcgaccggcttgtacgagggcgagcccccgtcgaacccggccgcgatcacggtcacccgcacctcgtcgccgagcgcgtcgtcgatgaccgcgccgaagatgatgttcgcatccgggtgggccgcgtcggtgaccagctgcgccgcatcgttgatctcgaacaggccgaggtcggagccgccggcgatggagagcagcacgccgcgcgcgccgtccatgctctgctccagcagcgggctggagatggcccgctcggccgcctcgacggcgcggttgtcgccgcgcgcgctgccgatgcccatgagcgcgctgcccgcgttgctcatcacgctcttgacgtcggcgaagtcgaggttgatcagacccggcgtggtgatcaggtcggtgatgccctgcacgccggagagcaggacctggtcggcctgccggaacgcgtccatcatgctgatcccgcggtcgccgagcgcgagcagccggtcgttcgggatcacgatcagcgtgtcgcactggttgcgcagctcgtcgatgccggcctcggcctgcacctggcgccgcttgccctcgaacgagaacgggcgggtcaccacgccgatggtcagcgcgcccagcttgcgggcgatgttcgcgaccaccggggcgccgccggtaccggtgccgccgccctcgccacacgtcacgaagaccatgtcggcgcccttgagcacctcctcgatctcgtcacggtggtcctcggcggcgttcttgccgacgtcgggctgggcgccggcgcccagtccccgggtcagttcccgaccgacgtccagtttcacgtcggcatcgctcatcagcagggcctgggcatcggtgttgatcgcgatgaactcgacgcctttgagcccaacctcgatcatgcggttcacggcgttcacgccgccaccgccgatgccgacgaccttgatgaccgcaaggtagttgtgcggaggtgtcatcgggctcagccttcccttccggggttggcgatcgtcaagggcccctgcggttccggtgggatccgcacttcgacgatcgctgccgtccaagggagggcgaggaaaccctcaccctctactagaggtttaaagttatgtcaaccactcaaacctctcgacgcaacgtatgcggacatcgcgctcggaccaaagaacccgagcggcgtgtcgcgtgcgcttatgtggcgagtatgcgactcacccgtaacctcggacgaaatattccgttcgtacgtttttgtcggttctgtgatgtcttaccggatagtaacgatcttcggtgcgctcacgtcgatttccgacgccctgttcttcaacagtgccgtcgccaccttgctcttcaggtcgctctcggtgtcgtctccccagatcaccacccggccgccgcgcaactccagccggatcgccaccggtgagatgaccgacacggcgtccagctgctcgcgcaactcgtcactgagggcggccagcaccttcagcgccgacccggtattagcgtcgttcggccccggggtcgcgaccttggccaacggcagcccgtccggtttccgctcggccgaccggaacggcacgccggcccggtcgatcagggtgaaaccgctccggcccggcaccgcggccaccgcgacccgctccaccacctcgatccgcagggtggacggccaggcccgggtgaccaccacccggtcgaccgcggccaggccgcgcacccgggcgctcacgtcacccaggtcgacccgggccagcggctgccggtccggcaccgccgcggcggcccgcacctgagccgcgtccagcgtctgcacgccgaccacgtcgacggtccgcaccccgagcaccgccgtgccgtagaacagccaggccaccccgccggcgaccagcagcaccccggccccgatcagccagggcagcgcggcccgcagccgccgctgccgggcacgggccatgaaccggcgggccgacggcggcaccgcgtcggtgtccgcgcgcaccagtcgccagttgcgcgtgcccggcccggccacccggtcagcccgcgaaatccggggtcaggtcggcctcggcgagcgcggccagcagctcgtcgcccatcagcgagatcggcggcgcgcccatggtcaccaccacgtccccggggcggctgcggcggaccacctcggccgggacgtcatcccagtccggaacgaagaccttgcggtcggcgggcaggtcgatcgcggcggtcagggcgaggccgccctcaccgggaccgcgggtctcccccggcccgaacacctccatgatgatcgcctggtcggccagcgccagcccctcggcgagttcggcctgcaggtcccgggtgcggtacacccggtacggctggaagaccaccagcaggcgcccgtcgccggccacctcgcgcagcgtgcgcagcgcggccagcaccgaggtcgggtggtacgcgtactcgtcgtagacccgcacgccggccgcgatgcccttgcgctcgaaacggcggcgcacccccgggaacgactccagcgcctcggtgatcttggccagcggcaggcccagcttgagcgcggtgagcacggtcgcggcgctgttcaggcccatgtgcttgccgggcagcgcgagcttgaactcaccgagcgtctcgccgtgcaggatggccgtgtagcgcaccccgctgacggtcgagaccacgtcggtgatccgcaggtcggcgtcggcggactcgccgtaggtgtagaccgtcctgccctgcgcccggagcccggcgatcagctcctcggtgcccggcccgtcggcgcaggtcaccacgaacccgtcggccagcccgccgaactccaggaagcccgccttgagcgtctccaggtcaccccagttgttgaggtggtcaccctcgatgttggtgatgatcgcgacgtgcgggcggtagatcaggaacgaccggtcgtgctcgtcggcctcggccacgaagtgtggcccgctgccgtggtgcccgttcgacccggccgcggagagctcgccgccgatcacgaaggacgggtcctggccggcgtgctgcaggatcaccgtcatgatcgaggtggtggtggtcttgccgtgggtgccggccaccgcgatggtctgtcggccggtcatcgccgcggccagcgcctccgagcggtgcaggacccgcagcccgcgccggcgggcctcgaccatctccacgtggtccttcgggatggcggtggagtagacgaccgtgtcgaccccgtcgaggttcgacgcctcgtgggccatgtgcacggtcccgccgagcgcgcgcatcccggccagggcgggccactcgcgcagctcgctgccggagaccgggatgccccgggtcagcaggagccgggccaggccggccatgccgacgccgccaatcccgatcaggtgcacgctgcccagttcctcggcggtcatctcaccggccggcgtcaactccgccgtgttcaccacgtctctccctcgatcactgaaatgctcaccggtccaccgcttccagaacgaagcgcagcaactgctcgtcgccgtcgcgccggccgtaccggccggcggcgtgacccatcgcggccagccgctgccggtcccgggccagcgggatgatgttccgctcgatccactccggggtcagctcgctgttgtcgaccagcatgccgccgcccgcctcgaccaccgggatcgcattgcgccgctgctcctggttggagaacgggtacggcacgtagatcgccggcatgcccagcgcggtggtctcggcgacggtgatcgccccgccccggcagagcatcaggtcggcggcagcgtatccgagctgcatgtccgacaggtagggcacgacgacatagggcaccggcaggtcgtcgggcacctcgaacgggtcgttgcgcccgccctgcacgtgcagcacctggatgccggcgtgggccagccgcttggccgcggcggccaccgccaggttgatcgtgcgggcgccggacgagccgccggagacgaacagcaccggcaggtcggggcgcagcccgaagtggtagagcgcctgcgggcgcaacgccgggcggtccatccgggtgatcccggtccgcagcgggacgccgaccaggcgcgcgttgcgcagcgactcggcctgctccagctggtgcgggaaacccacggcgacccgcttggtgaatttcatccccatccggttcgccacgccgggcggcacgttcacctcgtgcaccacgatcggcagctcgcggcgccaggccgccaggtaggccgggaccgacacgtacccgccgaagccgaccaccacctcggcctgcacctcgtcgaggatctccccggccgcatgggtggacttgtacatccggtccggggtgcgcagcaggtcgaagttgagcgagcggggcagctggaacgccgggatcacccgcaggtcgtagcccgccgccgggatcagctggttctccatgcccttggggctgcccagcgtggtgatccggatctgcgggaaatggcggcgtaaggcgtcggcgaaggcgagcagcggatagatgtgtccgccggtgcctcccccggcgagcacgaccgaccgcagctgaaccatcaccgtctcccctcgccccccgtacgcaccggttgtcccggccgccgctgcggaggaaccggcggcagcggggcccagactagtcgcacccatcggggcgtcggacgggcgttcaaagctcgggccgcgtccggctccgcccgggcgaacgaggccagcatgccgatcgccgccatggccaccacgagagcgctaccacctgcggagatgaacggtagcggaaggccggtgatgggcagcaggccgaccaccccacccatgttgatcaccgcctgggcgaccagccaggtggtgatcgcggcggccgccagccggcggaacgggtcggccgagcggcgggcgatccggaatccggagtaggccagcaccgcgtagagcgccagcaccacgacgcagccgaccaggccgagctcctcggcgacgatcgcgtagatgaagtcgttctgcgcctccggcacccagccccacttgagcgcgcccttgcccaggccgacgccgaaccagccgccctcgaagatcgccgagcggccctggacgatctggtagcagacgccgttcgggtcacacttgtccagcggggtgaggaacgcggtgatccgctgcacgcggtagttcggcgcgtcggtcgagcccgacccgccaccccgggacgccgcggcgatcagcagggcgatgccggtcaggccgaacaccccgagcgcgccgaagacccgcagccgcaccccggccgcccagagcaggccgacgatcagcgcgagcagcaccagcatggtgcccacgtcgttgtagccgaccaggaggaacagcagaccgaccaccgggaacagcggcatcgccagctcacgccagcggctcagcgccgggcccttgcgggcgatcatgtcggcgccccacagcacgatgcccagcttggccagctcggagggttggatgacgagcccctggaaggagagccagagcaggctgacccgcagcgggccgacctgggcgctgtggttctcggtgacgtgcttcacctcgaccagcacgtcgaggatcaccagcagcaggatggcgaggcccagcacgtacttgccgacggcccgcagggtgatcgccggcaaccgctggaagacccagaacgcgaccaggccgagcagcgcgaagaccgcctggttggcgatgccggagaaggcgttgccgtcggccgcgtacgactgcacgctggacgccgagaacaccatggtgagcccgatcagcagcagcatcccggagctggcgatcagcaggtagtacgacgagaggggtcgggccagcagcccgtgcaccgcgggcagcaactgccggctcagtgacgggcggtcctgtcgggtacggtcgtccgccatgcccacatcatcgtcgggcggacacgccatcgacgtgaccatcgatggcgtgtcacctgagagttagcccatcaccgcgagatggtcgctgtagaacagccccaggccgatcgcggcgcagatgcccgcgatgatccagaaccgcaccacgatgttcacctcggaccagccggccagctcgaaatggtgctgcaacggcgacatccggaagacccgcttgccggtggtcttgaacgagatgatctggatcaccacggacatcgtgatgatcacgaagaggccgccgatgatcaccgagagcagcgtggtccgggtggccaccgcgaggccgccgatcaggccgcccaggccgagcgccccggtgtcacccatgaagatccgcgccgggttggtgttccaccacaggaagccgacgcacgcggcggccgcggccgccgcgatcagcgcgatctccagcgggtcccggacctggtagcagtgcgtctgggtgagctcgttggtgagccggtagtcgttgtcaccgcaccagtgccggtactgccagaagccgatcagcgagtacgccccgaggaccaggatcgacgagccggtggccaggccgtccaggccgtcggtcaggttcaccccgttggacatcgccatgatcacgaagacgaagaccatcaccgagccgaccttgccgacgtccagccagctcacgtcccggatgaaggagatgtgctcgctggccacggtttcgccgttggtgctcgggaagtacagcgcggcgatcccgaacccggtgccgaccagcaactggccgagcagcttgcccttggcggacaggccgtccgagttgcgcttgcggaccttcaggaagtcgtccaggaagccgaccgcgccgcagaagacgaacaggcccagcagcaccagggcggtcatggtgggccgctcctgggcgatctgccggtccgggagcgtggtcagggcgaggtgcccggcgacgtacgcgaagaccgtggcgaggatgaacgccacgccacccatggtcggggtgcccttcttgcccatgtgggtcgccggcccgatggtgcggatcggctgcccggccttgagcgccgagaagaccttgatggcaatgggggtgccgaagagcgagatgagaaaggcgaccgcggccgcgacgatgactgccctcacgtgggctgaacctcctcggggcgccgcagccagtcggcgacgtcccatgtgcggtaccgggaacccttgaccagcacgacgtcgtcggcgcgcaggtcggactgcagaatctcgatggcggcggcctggtcggcggcgaacagggcggtcccccgccacccgggtgccgccgcggctccgtccaggatcgggcgggcgttgtccgccaccgcgatcagccggtccacacccagttcggcggcgagccggccgacctcggcatgcccggacacctcgtgctcgccgagctcggccatgtagccgagcacggcggtggtgcgcttcccggcgcccatcgcggccagcgcgtgcagcgccgccgcggtcgacgacggattggcgttgtacgagtcgtcgacgaccgtcaccccgtccggccgctcgatcacgtccatccgccgcccggagacgatgcccacctcgccgagcgcggtggccaggtcgtccagcggcatcccggcggtcagcgcggccgccgcggcggccagcgagttcgccacctgatgccgcccggccacgccgagccggacattcctcacttcaagaccatgatggaggacgtacgacgcccgccccgccgagtccaccgtgacccccgtggcgcgcagatcggcgtcggccgcctcgccgacccgcagcacccgcgccccggtccgcgacgccatcgccgcgaccagcgggtcgtccgcgttgagcaccgcgaccccgtccgccggcagcgcctcgaccagctcgcccttggcccgcgcggtgccctcgatcgagccgaactcgccgaggtgcgcggcacccacgttgagcaccaggccgatcgacggccgggcgatcccggtcaggtaccggatgtgcccgatgccccgggcgcccatctccagcaccaggaaccgggtctcccggccggcctgcagcaccgtgtacgggaagccgagctcgttgttgagcgagccggccggcgccacggtgggccccagccgggacagcagctgccccaggtagtccttggtggtggtcttgccggacgagccggtcaggcccaccacggtcagctcgggcagccgggtgagcacctcgtgggccagcttcgcgagcgcggccagctggtcctcgaccaccaccccgggcgcgccggcgtcccgggtgccgagcaccccggccgccccggccgcgaccaccttcgggccgaagtcgtgcccgtccgccttctccccggcgaacgccacgaacagcccgcccgggcccacccggcgggagtcgtactccacgccgccggtgaccgtctccgagccgtcgctgttgaccaggtggccgccggtcacggcggcgatctcggccagtgtcatcgggatcatgcgcggccctccagtgcggcggccagttcgatccggtcgtcgaacggcagcacctggccgttcacctcctggccctgttcgttgcccttgcccagcacggcgatcacgtcgccggtggcggccagccggaccgcctcgacgatcgcggcccgccgcccggccacttcgacgaccttgccggcgtgcgcgtcctcggcgccacggcgcaccccgtcccgtacgaaagcggggtcctcggtccgggggttgtcgtccgtgacgatcaccaggtcggcgccccgggccgccgcctcgcccatcagcggccgcttgcccctgtcgcggtcaccgccggcgccgatcacgcagatcagccggccgccgcgggcggtggccaggtcacgcagcgcggccagggcggcgacgatcgcgttcggcttgtgcgcgtagtcgaccacgccgaggatcccgctctgcgccggaacctgttccagccgcccgggcacgccccggcagtcccgcacgccggcgccggccacccgcggatcgatgccggtcgcgaccagcagcgcgatggccagcagcgcgttggcgacgttgtgcaggccgggcagcgccacacccgtctcgaccgtcacgccgtccgggccgtgggcggtgaagagctgaccgaacgcggacgggcggacatcggaggcccaccacgtggcggattcgtccccggccgcggaataggtcaccgtttccggggtggcgagcgacatcaccgcagcgtcgtcccggttgagcacgccgaccgcggaccggccgtcgaagagccgggccttggccgcgaagtactcctccgacgtcggatggaagtccaggtggtcctgaccgaagttggtgtagccggacgcggcgaaccggatgccgtccgcccgccccatcaccagggcgtggctggacacctccatcaccaccgcggagaccccgcgctccaccccgaccgccaggatcgcctgcaggtcggtggcctccggagtggtccgcacgctcttcacggtgaagtcgccgagccgggtctccaccgtgccgaccagcccggtcacccgcccggcggcccgcaggccggcctccaccaggtacgacgtcgaggtcttcccggccgtcccggtgatgccgatcatggtgagccgccgggacggctcgccgtagatcgccgcggcggccgcaccgagcaccgctcgggggtcgtcgaccgtcagcaccggcaacccggcggcgagcgcggcgtcccgcccggccggatcggtcagcacggccgccgcgccggctgaggccgccgcgtcgacgaactcggcgccgtgccggttcgcgccgggcagcgccgcgtacagatcacctgggcgcaccgcgccactactgtgagtgaccccggtgacatcgatgtcaccaccgtgcagcgttgccctcagcagctcagcgagccgcgtgagggggagcggtgcgacggtctcgggtcggggaatgccggacacggcgtcagaccctacccggtaggccaggtgttcctgtcaacgccatccggcccggcttcatccatggatcttgaaagtcggcggtttcgtcgtggacggcggcaccgaattgcgcagcagcgtgtccgacatgatctgggcgaacgccggagcggccacctcaccgccggtgcccttagccacgtccatcgcgaccgcgaccacgtagcgtgggttctccgccggcgccatcccgacgaacgagctggcgttgtggctggtgtactcgccgtcgacgaccatcttgccggtgccggtcttgccggccacccggtaaccgggcacctgggccttcaccccggtgccctcgctgtcctcgaccaccgtctccatcagcgtgcgcagctccgcggcgatcttggcgtccagcacccggtgcgtctcgggcgccggcgccggggtcgtcgtgtgatcggttccggacaccgtcgccttgatcaggtgcggctggatgtacacgccgtcgttggcgatcgcgccgtacccggccgccatctgcaccagggtggccgagacgctgtgcccgatcggcaccgaccccttcgccgacccgctccagttctgcggcgccagcagctcaccgggcgcctcaccgggcatgccctcgccggtcgccttcccgagcccgaacttctgctggtactcgtagatcttgtccttgcccagccggctgccgatctggatcgtgcccacgttggacgagtaggcgaggatcccggcgatggtcagcctgctgcccttgggctggacgtggctgtcgttgaacgtcttgccgccctcgacgatcgccggcgcgacctccaccgtcgagtccggggtgatcagaccctcctgcagggccgccccgatgacgaacgccttgtgcgtggagcccgggtcggtgaccaccgcggtgggcacgtcgatccggtcggacggctggtactccagcgccttggccgcgttgtagtacggatagctggcctgggccaggatctccccggtcttgacgtccaggaccaccgcgccggccaccgtggcgtggttgcgctccgcctcggcgtccaggatgtgctgcgcgttccactgggtgaagctgttgatcgtcagctgcagcgagccacccggcttggccggcgtctcctgctggtacccgccggcgatcggaccgtccagcttgcccttgccggactcgaagacccacatcccgtcggtgccgtgcagcaggtcgtcgtagcgcgcctccagtccctccagaccgtgctgatcgtcgccgatgaacccgatcaggttcgccgccaggtccttgccgggcagctcacgccgctcgtcggcgtgcgtgtagatgcccggcttcttcagcgcctcgatctggttggccaccgacacgtcgacgccccgggccaggtagctgaactgcgacgcctttccgtcgaccatcttcggctgcatgctcgcggccagtttggaggccggcacgccgagcagcctggccagcgccgccgccgtacccgggatgtcgttctgcagccggggattgctcgggtcggcgaagatgtagcgcgcctcgacgctgttcgccaggatgttgccgtcccggtccaggatgctgccccgcgcggccggcagcttgatcgaatgcatccggtcgttgcgcagatcgaccagcttgtccacctcggccggcgaggtcgccacctgcagcaccaccagccggatgccgatcatggtgaacagcgacagcgccaggatcgtgcccagccgcagccgccgtgtgctgttggcgagcttcggcggctcggcgggcaccggccggagccggcgcgccggctcccggcccggaccgcttccgccggtcacccgccgtcgtgccccggcttccggatcggcggtacgccgtgagcggggctcgtccgcggaggcctgacgcgccctgggctagctagctaggccccccgggcgccggttcccccggtccgggtgtcgcggccggctccgcgtgcgcgctccccggcagtggagcgcggctgcgccgcacggccccccgaccgcggcgcctctcgctcgctcatgctttcccctccccctcctggttcagccccgggcgtcgccgcccttgtcccccgtgctcggcgaccatccggggccgttcgcggccggccccgcccggctggttcgccgtcttacccagttcgatccgttccaccgcgcgcagcttcaccgaagccgcccgcgggttctccgccacctccgcctcgctgggcaactccgaccccctggtcagcagccgcagcgtcggacccgtcccgggcagctcgaccggcaggtcgatcggcccggtgctgcgcgctctcgcggtgagcgcccgcttgacgatccggtcctccagagattgataactcatcaccacaagtcgcccgccgggcgacaagacgtccaaagccgcgggaatcgcggactcgagcacatccagctcgccgttgacctcaatgcgtagtgcttggaatgaccttttcgcgggatttccacccgttcgccgcgcggcggccgggatagcgtctttgatcagctccgccagccgggccgtggagacgatccgcgccttctgccgctcccgcacgatcgcgctgaccacccgtggcgcgaacttctcctcgccgtactgccgaaggatccgcaccagctcgcccggctcgtacgtgttgacgacctcttcggcggtgatcccccgcgactggtccatccgcatgtccagcggggcgtcctgcgcgtacgcgaaaccgcggtccgcctcgtccagctgcagcgaggacacgcccaggtcgaagagtccgctgtcgatcgccgggatgtcgagctcgtcgagcacccggggcagctcgtggtagaccgcgtgcaccagatggatccgctcggcgaaccgggccagccggtgccgcgagtgggcgagcgcctcggtgtcccggtcgagtccgatcaggaccgcctccgggaaccgctccagcaccgcctcggcgtgcccgcccagacccagcgtgaagtcgacgtgcaccgcgccgggccgggccagagccggaccgagcagctcgaggcagcgttccagcagcaccggaacgtgcgcgccgcgcggctcccccatgtcgacccccattgacccacccgctcgcgttccactcggttcgttgccgtgttgccgtgccctgctgatccgtaccggcccggccgcgcatccgtaccgccagatccccatccgctcgcatcccgcgccggctggcgccggctggggacacgcgcctggcgccggggaagaggcgccaggagcgggagcggctggagatctcgcagtacggcagcagtggcgtccgggccgcactcccagcggcccaccgagtgccacgccctacagtccgccgggcagcaccccctcctggatgtcggcgaagtcttcctcgctcgccgagaggtagtcgtcccaggactgccggtcccagatctcgaccctggtgctggccccgatcaccacgagatcccggccgagactcgcgtactcccgcagatgcgtggggatggtgacccggccctgtttgtcggggacctcgtcgtgcgcgctggcgaagaacacccggctgtaagcccgggcggccttgttcgtcaccggcgcctcacgcagctggccggcgatccgctggaactccggcatcgggaacacgtacagacagcgctcctgccctttcgtgatcacgacacctcccgccagctcgtcgcggaacttcgccgggaggatcagccggcccttctcgtccagccgaggggtgtgcgtgccgaggaacatcggcccccacccctttgccgggacgaccgtcccttcgcggagggagcggaccgtctgtcaactcgggccggcaggctccgcggttcgagtcccagggtttcggttcctcggtcctgccactgggccccactctactccacttccctccacctgcaacccgaaagcaaccgctcgcgagcccttttcgcggacgtaatcccagttcacaggtggtggagcaaacgcagcccgccgagcatgatccaccacgtccggtttccgacatccggctcagcgggcggaaaactcccccggaaacgcccaccgcaccccgcacgaaagccccgcaaacccgcccgtggaggaaagtggagccctccggtggagaaaaatggagcctccaccccgcctcccccgggctcctgatccacccgccaccgcgctccactcccgaccacccaccccctgcgggcccaccctccacagtcgcgccaccacccttaccggcccacgcaccaccaccccgcccagttggccgccgcccgccggccccggcgcccaggccagcgtcagtcgagggggcgagccgcgcgcggccgcgacgatcgcccggcgaggcagagcgggatgcggacggggcgggaccaccgacgtaccgggaagcaggaacctgaggaagcacggaccgtgagccgacagcggccggaacgccagtggggcgcgatccgatgcggatcgcgccccactggcgttgcttccttacttactgcacttactgcgcttaccgccgccgccgtccgtcatccaccgggaaacacccggcggcagccggtcgaggcggaggccgacgactggtcaggcgatgcggcgtacgacgtagttgctgccgtacatcttgtgcttgccgacccgggccccggtgtgcggcgagtcgtacatgtagccgccgccggcgtagatcccggcgtggtagccgtacgacccggaccggaagatgatcagatcgccgggctgggcctggctcttgctcaccgcgctgccgtagcgctgctgggcgtcagccttgtgcggcaggctcctgccggccgcgaccttgtagacgtagagggtgaagccggagcagtcgaaccgtttcggtccggcggcggcgaacttgtacagggcgccgacgtgcttcttggcttcggccaggacccgtgcgccgccgttggcgcggaccgtgatcagcatgcgtgagctggaggtctgcgcgtagccggtgccggtgaacagggtccggatgtagatcgacgacttgggcccggtggtgaaggtgaccgcgccggtgctgctcttggtggcccacgtctgccacttgccgccgcggtagccctgcaggcggatggtgcccttggcgatcttgccggtcttcgggttgatcaccttggcggtgaccttgaggacggatcccgcggtgatccggcgagcggtggtcgtggtggtcagcctgggctgcacgagggttttggcggcggccggcgcgactgcccggacggtgttcgcggcggtggtgaccggcgtcgcctcggctgctacggcgggcgacgcgccgatcagctggccggcgcagaggcagagccccagggagagtgctgcggtaccggcgccggacatgcggcggccatggctcgaacggtgttcgtgcacggtaaggttttccctccggcacgcctgcgaggttagctgtcgggttcgggcgggaaggctgcccggccacctgagtggcttcaccccaaggtccacgtcgcccgtggggcgcgacgctggtgcggaccgggattggttcccccgtccctgccccctgatgccttgtcagctttcggtgcattgcggtggtcgcgtcgaccagtccggggcagggctcggcgtggtccggtcggcgcggccggcgagcggttgccgccggtgaatctttggtacccgacttcgccctcgatcgtcaggtgcgatgtgattactcaccgtgattggcacgtgagccactgtccaatttgctagctccggaaaacaaatgtcattgctttgagtgctcgaccgcatacgatctgtcgatccaggtcagtgaaccagaacacacattttttcggccggtaacccggacgagcgcacacgcggtaactcgaccggattacccggcccgccatcggggaccggaccttccggcaactcgacgtgaccccgcggtccggtaccctcgctggcgtgacggacgggaagatgcccttgcgggcgatagtcgcgaccaccgcgtcgaagaccgcggcggcgctctccagggccgcgggccgcggcgacggctcggtgatcggcggctggatcggcctcaagatcgaccccgacctgctggcgcatctctcctcgggccgggcggtggcgctggtctccggcaccaacggcaagacgaccacgacgcggctcaccgcggccgcggtcggcgtgctcggccgggtcgccaccaactcgtacggcgccaacatgcccaccgggcacacctccgcgctcgcgaaggaggggcacaccccgttcgccgtgctggaggtcgacgagcactacctggcccaggtgatcgacgccacccggcccaaggtggtggcgctgctcaacctctcccgcgaccagctcgaccgggccaaggaggtggcgatgatggcgcagctgtggaagaccgcgctggccggccaccccgagatccgggtggtggccaacgcggacgatccgatggtcgtctgggcggccgccggcagcccgcagtccatctggttcagcgccggtcagcgctggcacgacgactcgttcgtctgcccggagagcggccacccgatcgagcgcgcgaacggcgactggtggtgcaccggctgcccgctgcgccgcccgaccccgcagtgggtggtcgaggaggacggcgtgatcgacccgcgcggcgactggcacctggtcaagctgcagctgccgggcaaggtcaacctgggcaacgcggccaccgccctcgcggtcgccggcgaattcggggttcgcccgatcgaggcgctcccccggctctcccgggtgacctcgatcgcgggacgctacgcccaggtcgaccgggacggccgcaacatccggctgctgctcgccaagaacccggcgagctggctggaggcgttcgacatggccgaccaggcgccgaccctgctctcgatcaacgcgcgggaccccgacggcctggacacctcctggctgtgggacgtcgacttcgccccgctgcgcgaccgtccggtcctgatcaccggcgaccgggcgttcgacctggccgtccggctgcaggtgaaccaggtgccgttccggcacgtacacaccttcgacgaggcggtggcgcaggtgccgccgggccggctcgaggtgatcgccaactacacggcgttccaggacatccgcgcggtgctcgaccgtgtcaactaacaccgaggtcacagcatgaacgacagcaccctccggatcgtctggatctaccccgacctgctctccacctacggtgaccggggcaatctgctgatcctggcgcaccgggcggcggcccgcggcatcccggtcgagacctacgaggtccgctcggacatgccgatgccgacgaccgccgacatctatctcatcggtggcggcgaggacggcccgcaggcgctggccgcccagcgactgatcgccgacggcgggctgcaccgcgcggtcagccagggcgcctcggtgctcgcgatctgcgcgggttaccagctgttcggtcactcgttcttcgccaaggggaccaaatgtgccgggctcggcctgctcgacatcacctcggaccggggtgagagccgggcggtcggcgagctgcggggcgacatcgacccgcggctgggcctgcccccgctgaccggtttcgagaaccacggcggccgcacccacctgggcgcacacgccgcgcccctggcccgggtgaccggtggcatcggcaacgacgggcagaccgagggggcctgggccggcaagatcatcgggacgtattcgcacggccccgcgctgtctcgcaacccagcgctagccgatctgctactgcgttggtccacgggcgcggataggcttgcgcccctcgacgactcctgggccgaccggctccggggcgaacggctcgccgcggcgagcccggcttaagacggaaagagctgcacgaccgattcgggaaccggcgagaaagttggggcggtaaggctgcatgaccgacacacctgatcaccacacgagcgtgccgtcccgccggaagcgcctggtccggctcggtctgctcgccgtcgtgatcggcgcgctggccgcggcctccgccctgctcccgctccgcgacatcggtgacgcggtggtcgcgctcggcccgggcgcggcggtcgccgtcgcggttctcggcggcctgctgctgtcggcgctggtcccgcggaccgcggtcacggtcgcctgcggcgcgctgctgggcgccgcgatcggcgcggtctagctagctagcctactacctgggccgctgggccggtcgcggggtgctgcaggcgcgggccggcggccggctggcccggctggacggctggctcaaccgccgcggcctggccgccgtgctgctggtccggttcctgccgctggcgccgttcggcctgatcggctacgcctacggcaccaccagcgtctgccgcaagcgctacctgctgggcaccacgatcgccgccatcccgtccacggtgacctacgcggtgatcggcgccgcggtggcctcaccgggccggatgaacgcgatcacgatcgcccccgcggtggtcagcttcatcctgtcgacggcgatcgtgctccgctggcgccacaccgcccgccgcgacgccgcaacggcaccgtcaactgccgattcggccgtacgggcgtagcagcaccgccgcgccgcgcagcaccgccgcgcctcgcagcaccggttttccggccccgccgcgcctcccgggagcatcccatcagcccggtgagcggccgtccgcccgggtgaggaagctgccacgctctccctcacccggcggccccggtcgtcccgtcagacgacgacgctgaccaggcggcccttcaccacgatgaccttcttcggctccttgccgcccagcgcctcggccacggcggccagggcctgcgcccgtacctccgcctccggggtgtccggagcgacctcgacccggccgcggaccttgccgttgacctgcaccgggtaggtgatcgagtcggcgaccagctgggccgggtcggcctgcgggaagtcggcgtacgccagcgtccccgcatggcccagcctgccccacagctcctcggccaggtgcggggcgaacggcgacagcatcagcaccagcggctcgaccgcctcgcgggacaccgtcgccagcggggtcagcgtgttggtcagctcgatcagcttggcgatcgcggtgttgaaccgcagctcggccatgtcctcgcggaccccggcgatgacccggtgcagcaccttgcgcgacttcgggtccagctcggcgtcggtgacccggatcgccccggtctcctcgtcgaccaccagtcgccagacccgctgcaggaagcgctgcgagccgaccaccgcgcgggtctcccaggggcgggagacgtccagcgggcccatcgccatctcgtacacccggaaggtgtccgcaccgtactggtcgcacatctcgtcgggggtcaccacgttcttcagcgacttgcccatcttgccgtactcccgggcgacctcctggtcaccgtggtaccacttgccgtcgcgctcgacgacctcctcggccggcacgatgaccccacgggcgtcccggaacgcgtacgcctggatgtagccctggttgaacagcttgcggaacggctcgaaggacgagacgtggcccaggtcgaacagcaccttgtgccagaaacgggcgtacagcaggtgcagcaccgcgtgctcgacgccgccgacgtacaggtcgacgccgcccgggtcgccggggcgctgcggacccatccagtacgcctcgttggccgggtcgaccagcgcgtgatcgttgtgcgggtccaggtagcgcagctcgtaccagcaggagccggcccactgcggcatggtgttggtctcgcgggtgtacatcctgggcccgtcgcccaggtccagttcgacctgcacccactccttcttgcgggacagcggggtctccggctcggtgtccgcgtcgtccgggtcgaaggtgcgcggcgagaagtcgtcgacgtcgggcagttcgaccggcagcatcgactcgggcagcgcgatcggcagcccggtctcgtcgtacacgatcgggaacggctcgccccagtaccgctgccggctgaacagccagtcccgcagccggtaggtggtggcgccggcgcccttgccccgctcctccagccaggcgatcatcgccgccttggcctcgtccttgttcaggccgttcaggaactccgagttgatcacctcgccgtcgccgacgtaggcaccctcgcaaccttccggagtggcgatcgtccgaacgacgggcagctcgaacaccgtcgcgaactcgaagtcgcgctggtcgtggccgggcaccgccatgatcgcgccggtgccgtacccggccagcacgtagtcggcgatgaacaccgggatgctcgcgccgttgaccgggttgaccgcgtacgccccggtgaagacgccggtcttcaccttgccgtcggcggtgcgctcctcctcggtcttggcggcggcggtgacccggtaggcctcgaccgcctccgccggggtgccggcgaccttccaggcctccttcgtcccggccggccatgcggcgggcacgatcttcgagaccagcgcgtgctccggagccagaaccatgtacgtcgcgccgaacagcgtgtccggccgcgtggtgaataccgtgatccggtccgcatcgacggcgaagtcgacatgcgcgccctgcgaccggccgatccagttgcgctgcatcagcttgaccggctccggccagtccagcgcgtccaggtcgtcgaccaggcggtcgccgtacgcggtgatccgcatcatccactgcttcagactgcgctggaagaccgggtagttgccccgttcggaccggccgtccggggtcacctcctcgttggccagcacggtgcccaggccggggcaccagttcaccggcgcctcgctcacgtaggccagccggtggccgtcgatcaccttgcgccgctcggccggggacagggtggcccaggccgcgccccgctcgccggcctcgtaggaggcgatcagctcatcgatcggccgcgcccggccctgctccgggtcgaaccaggagttgaagacctgcaggaagatccactgggtccagcggtagtactccgggtcggtggtggagaaggaccggcgctcgtcgtacgccaggcccagccggcgcagctgctgccggtaccgctcgacgttggccgcggtggtgaccgccgggtgggtgccggtctgcaccgcgtactgctcggccggcaggccgaacgcgtcgaagcccatcgggtgcagcacgttgtaaccggccatccgctggaaccgggtgtaacagtcggtgccgatgtagcccagcgggtgcccgacgtgcagacccgccccggacgggtacgggaacatgtcctgcacgtgcagtttcggggcgccggcccgcgggtgtcccgggtcggccagctcgccggtcgggttgggcgcgtggaacgtcccgttctccgcccagtaccgctgccagcgcagctcgatctcgccggccagcgcggcggtgtagcggaacgggttgtcggtctcgctcatcttcaccatctcgtctacgtcagtgggctggtggggttccgcgctccgggcacaaaaaagcccctcacgcaggagggggcgccgcactgtaccgaagggtcggtcagcgcggccggctaaggagcagaacagaccaagccatgcgcgccatgatactcgctctccgtaacgccgggcgaccggtataccccgtacggccccatcactctcggtaaatggaccatgttcgtccggttttctcgaaaaccctgctcgttccggcctttcggaggggtgtaccggcggagctaacctgtcaggacgggcggcgagcgccggaggttcacggaccgctgggcgcccgcagacttggggtgccctgacgacggtgagtcgtccaccgcggggtacgtatcacttggaggaagcccgtgacaacgccgacctggggcgagccgaccggaccgctgtcgaacgccgagttccgcaccgcgacgcaggccatcatgaccaacatcgagcaggtcatcgagggcaagagtgcgacggtgcggctggccctcgcggtcctgctggccgagggtcacctgctgatcgaggacgtgccgggcgtcggcaagaccaaactcgccaaggccctggcccgctccatcgactgctcggtccgccggatccagttcactccggacctgctgcccagcgacgtcaccggggtgagcgtctacaaccaggagacccgggacttcgagttcaagccgggcgccgtcttcgccaacctggtggtcggcgacgagatcaaccgcgcctcgccgaagacccagtccgcgctgctggagtgcatggaggaacggcaggtcaccgtcgacggcaccacctacgagctgcaggcgccgttcatggtggtggccacccagaacccgatcgagatggagggcacctacccgctgccggaggcgcagcgggaccggttcaccgcccggatcgcgatggggtacccggacccccgggccgagctggccatgctcggcctgcacggcgaccacgacccgctcaacgacatccacgcggtggccgatgccgcactggtccgccggctgatcgacacggcccgcgcggtgcacgccgcggacgccgtccagcagtacgcgatcgccctggtcaccgcgacccgggaggcccccgagatccgcctcggcgcgtccccgcggtccaccctgcagctgctgcgcaccgccaaggcggtcgccgcgctggagggccgcgactacgtgctcccggacgacctgcaggcgctggccgtgccggtgctcgcgcaccggctgatcccgaccgcggacgcccagctgaaccggcgcaccacggacaccatcgtctcggagatcgtgcaccggctgccgatcccggtggccaaccggaatccgtacgacacccggaccggcggcacgcagtacgagtcccgggggcgatgaccatgcgggaggcgctgcggggactcaccacgcgcggccgctcgttcctggccgccgcgatcgccgccggcatctcggcgctcatcctgggtgagcgcgacctgctgcgcgtggcggtgctgctggccgccctgccgttgctggccgcggcgtacgtcggccggagccgctacaagctggcctgcacccggtcgctggagccgggccgcgccccggtcggctccagcgcccgggtgatcctgcgcctgcagaacctgtcccggctgcccaccggcaccatgctgctggaggaccgcctgccgtacgcgctgggcagccgcccccgggtggtgctggaacgtctcggcgcgcaacaggccagctcggtggcctacaccgtgcgcgccgacgtccgtgggcggtacccgatcggcccgctggtgatccggctgaccgacccgttcggactgtgcgagctgacccgttcgttccccagcgtcgaccagctcaccgtgatcccgcaggtcacgccgctcccccgggtgcggttggccggggagtacgcggggaccggggacagccgggcccgctcggtggcggtgcacggcgaggacgacgcggccacccgggagtatcggcgcggcgacgacctgcgccgggtgcactggcggtccaccgcccgcaccggcgagctgatggtccgccgcgaggagcagccctgggagagccgggccaccgtggtgctggacacccgggcgatcgcgcaccgcggcgagggtccgaccgccagcttcgagtgggccgtctcggcggccgccagcatcgcggcgcacctgcgcgaggccggctacaaggtgcgtctggtcaccggcgacgggtccgacctcgacggcagcgagcccggcggtgacggcctgatcctggacgccctggccgacgtgaaactcgccgcggccggcgacctggcgctgctggtcgagcaggtccgccggcgatccgacggcggcctggtgatcggcctgttcggcactctcaccacggccgaggcgcagctgctcgggcagctccgcggcaacggcgcgacctgcatcgggttcgccatcgacagcgacacctgggtgccgatgaccgccggggaccggcaggagtcggaccgggagcacgcggcggcgtcactggcgctggtccgtggcggctggcgctcggtaccggtcacgcacggcgacaccctgccggcgctgtggcccacggtgggccgcggctcacagggcttcgcctaccgcgcggcgatggccgagacggtcagcggggtgacccgatgaccggccgccgtcgtctcggactcgtcgcggccggcgccaccctgctcggctcggccccgctcgccaccatcttcgacacctggagctggctgctgcgggtggtcttgaccgtcgtgatgatcgccggcaccgcggtgctcacccggaccctgcggttccccagctgggcgcaggcgctcggcatggtcgccggcctgctgatcacactcacctggatcttcccgagcgggcacgagctgctggtgccgaccccggccacgctggcgcacttcggcgacctcatccagcaggccggggacgacacccgggcgtacgccgtgccggtgcccgaccgcgacggcctgctgttcgtggcgacgctcgggatcggcgtggtcgccatcgtggtcgacctgctcaccgcggtgttccggcggccggccctggccgggctgccgatgctcgcgatctactccatcccggtcgcggtctacctggacagcgtcccggtcaccccgttcatcatcggcgcctgcggctacctgtggctgctggtcgccgacaacgtggaccgggtgcgccggttcggccgccggttcaccggcgacggccgggacgtcgacgtctgggagccgtccccgctggcctcggccggccgccggctcggcctggccggcgtgctggtggcggtgctgctgccgctgatcgtgccgaccgtcaacggcggcctgctgtcccagctcacccagggtggcagcggggccggcggcggcctcggcaagggcggcggccagatcaacctgttcgccaagctcagcggccagctgaaccagaccaccacggtcaacctgctcaaggtgcgcaccgacgagaaggacccgttctacctccggttcggcgtcgccgacctgctcagcaacgacggcttcagcaaccagccgccgggcggcaacacgctcaaggcgggcagcctgcccgacccgcaccacgacggcgcgaccgaccaggtggccttccagcagcatcacgccgacatcgaggtcagcgacctgctgcggcagagcatggccccgatgtactcgaacccgatcgcgatcaaggatctgtccggcaactgggcgtacgaccccaaccagcaggtgctgtactccaaccgcagcaacaccggcaagcagaagtactcgatcgactatctgcgggcgctgtacacgccggcccagctgcggaccgcgccggccctcgggccggacgacccgatgcgcaagctgttcaccgcccacccggacaacaagtacgtggacacgctggtcgccgggctggtgaaggggaagacgaacgactacgacaagatccgcgcgatctacgagttcttctcccgcaagaacaacttcaactacagcgtgtcgacccagtccaccgggaacctctccgacatcgaggcgttcctgaggaacaagaccggttactgccagcagtacgcggcggccatggcgtggatggtccgcgacgccggcatcccgtcccgggtggcgttcgggttcacccgcggcaccccgcaggacaacggtgcgtacgtgatcaccaaccgcaacgcgcacgcctggaccgaggtctacctgcagggcttcggctgggtgccgttcgacgcgacaccggccggctcggtggccggcgcgtcccgctcgaactgggcgccggacaccgaccggaccgcgacaccgaccgcctcggcgacgaccgcaccggtcgccggtgccagcgcgtccgccgccgcggccggcaccggcaagcgccccaaccgggccgatgacggcagcgacctggccaccggcggcaccttcgagagcgaccagcagagctggaccggcctgatcgtcggcgcggtggtcgccacgatgattgcgctgctgctggtcccggccctgcgtcgggtcctgctccggcgccaacggcacgccgcgaccgtcgggccacccccggcgacctcggtcgacccgggcatcgccggaccgtccggcgcggtcaccgggatcgaggtgtcccccgggtcggcgcaggcccgggccgacgcccacgcggcatgggacgagctgatcgacaccatggtcgacttccagttcgcggtcgacccgaccgagaccccgcggctgaccgcccagcggttggtcaaggaggccctgctggaagcggacgcggccggcgccgccgagctgctcggcacggccgaggaacgggcccggtacgcccgccagccgatgcagggcgccgaactgaccacggccctgcgccgggtccgcgccggcctggcccactccaccaccgggtgggtccggttgcgggccgcgctgttcccgccgtcgatcctgctcagctggcgtctcggcctggccgaggcgggcacccggacgatggaggcggccgccagcaccggcgatttcctgacccgcttcaacccccgccgcctgctcccccgcgggcggtaggcgccgccagcggctaccagggactaccaggcagacgccgtcggcggccgcccgacaggcaccgccagcggccgcccgacaggcaccgccagcggccgcccgacaggcaccgccggcggccgcacgacagacaccgtcggtggccgccaccaggcgccgtcggcagccgccaccaggcggctgtcactcggcggctgccactcggtggcggccagcgacacaccacccgcctccgcgggcgccgcaccatccgcggcgggccgcatcgacaacgaccttcagcatgagcggcgccgtcccggaggacggcgccgcgtgaagtttccggcctcggcgtctgcccggctatgcgtgccggccccgacatgtgcggttgacccgctgggccggacagggcgtaccgcgggaagcagagaatgacccgacgggccgccacgcggcgcaccaccggaagcatgtaatgacgacctgatgcgcccgggcatggcttacggcacaccaccggaagcactcatgacgggccgcgggagcgtcacgacccaccaccgaaagcagagaatgacgactggacggggcgcgcggaactcacgacgcgccgccggaagcagagaacgacgacggcggcccggaggccgccgatcgtcgggtgccgggtggggccgtcagcgatgcccctccggacgctgcctccagcggtcctccaggcggtccagcagaccgccgttgcccttacggccctgacgggtgcgccgcgaggcggtcccgccgaccgacttgaggtcgggggcctgcccgcgtttgcgcgactgcatcgcgaacgcggccgcccccagcatcacgacgaagccggcgacgccgagcaacacggtgccggaagccgctccgtagacgacgagggccaggcccagcacgatcacgaacgcggcgatgatgagccggcgccgtgcgtggaaacgcgggtcgctggcccgcacagccgaggcgaacttggggtcctcggcaagcgaccgctcgatctgatcgaacagccgctgctcgtgctccgagagcggcacggcattcctccccgggcgcatgtccggcccaaagtggggccggggcagccgtcggctgccttatcacgcaagtctacgagggggtcggcgggtcggaaagcgggacgacggccgagtgcgggtgattttccctgcccggaagatcgattcgtccgaaaagcccggctcaccagcccaattacctatggtgaaacaatcacgacatcgagtgatgcggatgccgggcgctcagcgggcgatcaacaacggcacggtcatctcggccgcggtgaccgatccgtggtacgccaccagctgtcccgccttgaccggttcccacccggaggcgatcgccaccgcccggccgtggcagatcaccaccacgtcgccgatccgcccggcgtgcgcggccggcaccggcccgaaccagcccccggcgatcgcctcctcgcgggtcagtaccgatgcctcggcgccgaacaccccgcgccagctggcgatcacgtcatcccgcgcgccgtccgccacgtgcaggtagcggacccgggactcaccggcgaccccgaccacgccgtcccgcagctccgggatcgcggcgatgtcccggcggccctcgatcggcacgttcagctggccgtgatcggcgaccaccagcagcgcggagcgtggcggcagcccgtgcaccacccggtccagcagccggtccaccccgcgggccgccgcccgccagctcggcgaacccaccccgtcctcgtgcccgaagtggtccagatcggggtggtacccgtagaccagcgccggcccgtccgcctcgcgcagcgcggccagcatcccgtcggcgaccgcggcaccgtccgcggcgccgcggtagacgccgccccggttcgccgcgagggacagcccgctgccctcgaactgcggccggctgaccacggtgacccgcaccccggccgcggcggccagctccatccgggtcgggaccggctgccatcgccgcgggtccgggtcgtcgtcccacaggatgtgggtgagcggccggccgtccgggcggcggacggtgaatccgagcaccccgtgcgcgccgggcggcaccccggcaccgagcgtgaccaggctgaccggggtggtggacgggaaaccggcggtcagcgtcgcggcgtgcccacgcccgccggcggccaggtcggccaggaccggggcgtgcggcgcggcgagcggcagctggtaggcgccgaggccgtcgatcagcagcacggcgatccggtcgacgccgtccaggcgggcgccgagaccgagcacgtcggccgcgcccggcacgccgagcacggcactgacgctgggcagcaggtcggcgaggctgcccgacccgtacgccggatgaacggtccgcagcgcgtccggatgcagcccgtcgtcgggagccggcccgctcggatccacaccggcatcgacaagacgatcagcggcggacgacaggccgcccggatccgcaccggcgccggaaagacgatcagcggcggacgacgagccgcccgggtcagcgccggcggccgggacagcgctcatggccggcgcgcgaacaggtgcagctgggaggcgatgtcccggaacggcggctgcgcgctcagcgcgagctccagctccagcaccgcctgcgggtcctcgtcgagcacggcggccggcaacaggtcggcgaccacccgtacgccgtgggtctgctccacctcgaaccccgcggtccgcaggagcgcggcggcggtctccgcgtcgtaccgccggcgcagcgtgtcgcgcggcccggaccggccctccgggtcggtgaccagcgccgacgccgcccgcactagctagctagtcgcggtgaccacccgcgccgggtcgtcgaccacctccagcacggcgtggcacaggacgaggtcggcgctgcccggctcgaccaggccggcgagcgcgtcgccgtcgccctgcacggcccggacccggccggcgaccccggcgtcggcggcccggcgggtcagcgcggccagcgcgtccgggctggcgtcgatcacggtgacggtgtgcccggcctcggccagcggcacagcgaacccgccggtgcccccgccgacgtccaggacggtcagctcgcggccggcgttgcgctccagttcacggcgcaggacggcccagaccgcggcggtgcgggcggtgacgagcggccggccggtacgtgcgatagcggtgtccacgcgcgcaagcctatcggccggaccaacccgttatcaggaacggcgtcggtcagaaggcgaagagcaccccggtggcgcgggtcatctcgcagccgttgccgaaccgctgggtccacttcaccggccggccccgccaggtgccccgcagctgcgcggtcaccggctggtagagcatgaagcagagccggtcggcgggcttgagtctccgcgggtcggcgccgacccggccgagttcggcgcaggcctgggcggctttcgggtgctcgccgccgtccgggtcgcaggtgagccggacggccgccggacgccccgtctcgccggcgtaggtgaggacgagccgggattccggtcgggccgccgcggccggcgcggcggtggccaggacgaccgcggcgacgaaaccggtgcagatgcgtagcaacatggtgacgcaccctatgctatttgtcgggaaatttccggcatatcagcggaagtcgcgggaggctggtgtgaccggcgggtgcagcgcgtccaacctgtccgccaccaggttcagcaccccttccaccttctccagcctgccccgcaccagcagcgccgcactgctgcgcgccacccggcggtaccgcagccacagccccggcgagcaggtcacgttcagcatcccggtctcgtcctccaggttcacgaaggtcaccccgcccgcggtcgccggccgctgccggtgggtgacgatcccgccgacccgcacccggctgcccgccgccaccgtccccaggtcggcgatcgacagcgccccggccccggtcagctgctcccgcaggaaccgcgccgggtgcgtgtccggcgacagtccggtcgcccacacgtccgccaccagcaggtccacctcgctcatcccgggcagcgtcggcgcctcggtgccggtcaccgtccccggcagccggtccggtttgtcctgggcggccgcgccggcggcccacagcgcctcccggcgcgacaatccgaaggaggcgaaggcgtcggccgtggccagcgcctccaggttcgcgatcgagcatccggtccgccgggcaagatcggtcatggagcggtacggcccgtgttcccgccgttcgttctcgatcagctcggccaggtcggccccgatcgtccgcaccgatcgcagcccctgccgcaccgccgggccgccgagcccccagacctgcggcgcctcccccaccccggccttgcgccgggtgtccggggtggtctccagggtggccatcgcgtcgctgcggttgatgtccgggcggcgcacctcaaccccgtgccggcgcgcgtcgtcgaccagcgtctgcggcgagtagaagcccatcggctgggcgttgagcagcgccgcgcagaacgccgccgggtggtaccgcttcagccaggcgctcgcgtagaccaggtaggcgaagctcatcgcgtggctctccgggaagccgtagctggcgaaagcggacagtttgtggaacaggtcgtcggcgagttccccggtgatcccgttgccggccatcccctcgtacaaccgcctcttgatcctctccatcttctccacggaccgtttggagcccatggcgcgccgcaactgatcggcctcggccggatcgaaaccggccacgtcgatcgcgagctgcatcaactgctcctggaacagcggcaccccgagcgtcttgcgcagcgcgttctccatcagccggtgcggcacgtccggcttctccaggccgttcttgcggcggatgtacgggtgcaccgagccgccctggatcggccccggccggatcagcgccacctcgatcaccaggtcgtagaaccgggtgggcttgagccggggcagcgtcgccatctgcgcgcggctctccacctggaacaccccgaccgagtcggcccggcagagcatcgtgtagacctcggcgtcgtcgagccgcatggtgccgatgtcgagttcgtcctcgatcatgtcgtacgcatagtgcagcgccgacagcatgccgagcccgagcaggtcgaacttgaccaggtcgaccgccgcgcagtcgtccttgtcccactgcagcacgctgcggccgggcatccggccccactcgaccgggcagacctcgatgatcggccggtcgcagatcaccatcccgccggagtggatgcccaggtggcgggggaagttctggaccgcgttggcatagtcgacgaccatctcggggatgtcgctgtcggcggtggccacgtcgccccagcgatcgatctgtttactccacgcgtcctgctgaccggccgagaacccgaacgcgcgggccatgtcccggaccgccgaccgggggcggtacgagatcacgttggcgacctgggcggtgtgctcccgcccgtacttctgatagacgtgctggatcacctcctcgcgccggtccgactcgatgtccacgtcgatgtccggcgggccgtcccgctccggggcgaggaagcgttcgaagagcaggtcgtactccaccgcgtcgacattggtgatccacagggcgtagcagaccgcggagttcgccgccgacccccgcccctggcagtagatcttctcgcgccggcagaagtccacgatgtcgtacacgaccaggaagtagccggggaacccgagctcctcgatcatccgcagctccttctccagctgcgcgtacgccttcggatggtgctccccgtaccggacccgggcgccccgcatggtcagttcccgcagccagctcatctcggtgtgcccgggcggcacgtcgtagtccggcagccgcggggcgaccaggttcaggtcgaaggagagcccctcgccgtacatcgcggcgttcgccaccgcccccggatagtcccggaaccggcgtgccatctcggcaccgctgcgcaggtgggcggtgccggccgcgggcagccagccgtccatctcgtccagcccgcggcgggcgcggacggcggcgagcgcggtggccagccgacggcgtgccggggtggcgtagtgcacgttgccggtcgccaccacctccagccggcgctcccgggccagggtgcacagcgcgtcgttgaagtccccgtcgtacggatgaccatgatcggtcagctcgaccgccacgttcgaccggccgaacaggtcggccagccggtccagctcccaggccgcggcgtccatcccctcggtggccagcgcctgccggacggtgcccttgcggcagccggtcaggaccaggacgtggtcgtgcaggatctcggcgatctgttccagactctcgtactccggcttgcccttctccccgccacggatctgggcctgcgagatgacccgggccagccgcgcatacccgtcgtgaccgtttgccagggccagcaggtgggtgccctccggatccggctcgccgttctgcggccgggtcaggcccagcgacagttcggccccgaaaatcgtgggcaggcgcagctcccgggccgcctgggagaaccggaccacaccgtagaaaccgtcgtggtcggtgaccgccagcccggtcaggccgagccgggcggcctcctcggccagttcctcgggatggctggcgccgtccaggaagctgaagttggtgtgacagtgcaactcggcgtacgcgacctcggcgtccgaacggaccaacccgggagccgcccggtacggctcccgcttgcgggtccaggccggtgcatcaccgccgtcaccgtccaccacgagcggatcggcgacctgctccggcccgggagcggcccacaaccccggcttcccggccggtttcggcccgtctccgccccggtctgcgccaccgttcctccgtccgtcgagatcgcgtaccagatcggcccatggcctcgccggattgtggaaactcatcgccctgcccactcagtcatagatcgcctccaccacccactgccccgccgccagcgacaacaacagcgcccgcccgtcagccagcgacatctggaaccgggcccgccgccgcgcctcctccggcgcccaccaccgctcgtcgaccggccacggcccggcccacccggtgatcggcagcggcgccgaccgcccgacggccaggctggccggcgtgccggtgagctccagacgcgcggaaacgccgaccggaagcccgagctcgtcatgcaccaccgcgggaagcggctcgggcagcaccatcgccggtgacggccgcggcagacgtccgggccacggcggcaaacccacaccttcaccccgattgcggcgtacgccgtcagccgcgcccgccgcgcccctctccgccgccgcgcctttccggggtgccgtgcccccgttctctcggccgggcaggtcgggggcgatggcgcggtcgagcaccggaacggtgaccagaccgggaatcggatcggcgtgcaccgcggccggccgggccggggtgcgctcgtccccccacggcaccagccggacctgatcactcccggaccgcccgccgccgatcaccggggtcaccaccgactccggcccgagcaggccctgcacccggctgaacgcccggtgcgcccggtcccgttcggcgcccgcgtccccccacagcccgggttgcagcccggcgtgcgccagcagcccgtccgggatcaggctgagccggaccaggccggcggtcggccgggccggcccggaccgccggcccccggtcagccagccgtccagctgccagcgcacccggtcggcgatggcggccgcgcccagcagtccgtcgtgccgccacacccggtgcagttcctgcccgtccgcggtgaccgcctccacccccagccgggtgcaggccagcccgtgcccggccagccgttcgtgcagtcgttcggcgagcacccggccggcgaaggcggcggtgtccacccggtccagcggctcgtcgtacgtctcggtgacggccaggtcgaccggcggctgccggaccgccagcggccgatgatcgccgccccgggccagccgatgcgccagcgccccgtcgaagccgaaccgggtcagcacgtccccggccggcagcgcggcgaactccccgagtgtcttggccccgagccggcgcagcaggtcggccaggtcgggccggtccagcgcgtccaccggcatgccggccagaaacccggccgtccccccgaccgccacgatctgcccgccgcgcgccgcgatcccggccgcgaacaccccaccggcgatccccacctggctctccaccgcgcaggtctgcgccacatgctcgacgatccgctcggccgcggcctcctcccctccgtagtaccgggccggcccccgggcagccagcgcgcaggcccccggccgcaccacctccaccccggccgcgacctcctccaccgcggccaccaccgcctcaaaggtccgcgcatcccgccccgggtcgtgctccaccacgatcagatgcggacaccgcccctgcgcatcccgccgccgcagcccccgccggacactctcccgccgagccgcctcggaacaggccagcacccggttgttcgccatcaccgccaccgccccgtcccccggcacccccaactcgatctccgccgccaccaccggccaatccggacaccacaccatcagcgtccgcaccccctcctccacccccacgtcccctcccctcaccgctcagcccttcaccgcccctagctagctagccagcccctcgccgcccagcccctcgccgcccacctcttcgccgcccagcccctcgccgcccagcccctcgccgcccagcccctcgccgctcactcgcccgctgaggccccggccggcacttcatgccgcgccctctcaccgccacgcggaccggtgccccaccgtccacgccgcgctgaagccccaccccgccgcgacgtggacgcccccggctccgggtgctccgggccgggggtcgacgcggtgaggtccgggacggcgcggagcggccggttacccggggcgggcagcgtgctgccgggagggtcggccgtaaggtccgggagggtgggtacggcgaccggacggacgggtggggcgtccggcatgccggccgagccgacgggcagggccgccggggttcccgggcgggacgtcaggcccggcatccagagggtcagctctttggggcgggccgccgcgccgcggccgccggcgagcacggtgacctcgcgccggcgcagccggccacggccgtctccgaggccttcccagttcccccggccgacccgcagtgtcacgtcggccccggtccagtccccgaacggcaccagcacactgccccgctgccgcgcccgggccgccagccgcccggcgatggacgcggacaccggcccgggcaccgcggtcaccaccacgtccaccccgtcgatcagcgcggcgaccacggtcggccagtccggcccgggttcgggcaccagcgccagccgttccagcacgatgccggtttccgccgcggcgagcgcccccagcgccggcagtccgaccaccgcgcaccaggatcccgcccgggacgccgccgcgagcagcgccagcatcagcgaggtccccccgccggcccgcgccacccggcctccggccaccgccaccgtgctgccccggcgcagtccgcgccccggcagcaggttgcccagctcactggccaccggcagcatccggtgcgctcccggctccgccgcctcactcgccggccgaaccagttccgcgagcgcagccgtcccgctgatcatgcgccctgccatcgtgccccgccttgtatccccgtgtacttccccatcgcggcgacaccctctgcccgaacccgctacctatcgggccccagccccgcttcagctacatcacccgccgctacatcgccccgccacccagccacctcactgccacaccaccccgccgccgaaccgccccgctgtccagaccacccgccgccaaaccgtcccgccgccgaacctccccgccgccaaactgcccggccgccaaaccgtcccgccgccaaaccgtcccgctgtccagaccacccgccgccaaaccgtccggctgtccagaccacccgccgccagatctccggaccacctcgccaccagaccgccccgctgtccagaccgcctccgcaagatcgctacccgcctagtcatgtctgcccggcgctgaacttccgagccttccgacacccgcgggccgcgatctaggttcctgagcacggcgagcactccaaaggtgcgagtggacaaatccccaacgggcaagccggagttgccagcccatcagcgggagccggtcgaacggcaaagccggtcggaaatcagcgcagcgggcagccacccgccaccgctcagccgccgaatccctccgctcagccgccgaatccctccgactcgcagcgaccagggccttcgacgaacgcggatggtcaatacgaacgcgcagggtcaatgcaaacggcccagggtcgaggcgaacagcgcagatcaagtcgaacggtgcagatcaaggcgaacggcgcgggtcaagccgccaacgggggctgataggagaagcccagggaggactcggccaccgtcacgaactgctcggccgcacgcagcaggtcatccgcctcccgggcactcaccacctggggaatgcccgcctcggccgccgcgcgtttgctggcgcctagggcgaaatagcccgcccactcgccgaactccggcgcgaccatcaccagcagtgaccagacgctcgtcgccttggtgcgccgtccgggcgcgcccggacgagcccgagccgcgagcagggccgcggccgcgcgcagggcggccagatgagccgccgcgtatcgcagaccgtcgggagccgtatgcgccgcctcggccagcccctgccgcgcgatcgccagcagctgagcaggggtccgctgcggcaacatatgcgccggaacagtcggcatctcggcccgcgcactccccacgcccaccggaccgggcaccacaagagcggacccgaggccccgcccggaagccgccgaaacaggagatgccgggccagaaaccgccgaggcagaaaccgcctgagtagaagatgccgggatggaagccgccgaagcagccgccaccagagcagaggccggggcggaagccgccagggcagaggccggggcggaagccgccagggcagaggccggggcggaagccgccagggcagaggccgccgaagcggagagggcccgatcagaggccgccaaagcagaagaggcccgatcagaggccgccagagcagaagagggccgatcagaggccgccgggacggaaggtgggcggctgggggccgccggggcgggaggtgccgccctgccgggatccgggccggaaaccgctgtcagacccgggaccggcatcaggccgtgggccgtgctgctcgccatggtcgttcctcctcgcctgttccgcatccgacatgctggccgaaccggaccgccgcggaggaagacgcaacggacctggccgtgaccaccccctgccgggagtggccctacggccggggtgccggggccccacgggcagtaggagccccggctgcggaccggccggatgtgaagcttccccacaccacacccggccggtcaccgccggcgggtccgccgcccaccaccgggggtcgggggcagtgaacggcggcctgccttgtcgcgaggcccgaacccgcgaatgcccggaccacgcatgcggcacttcgcgggtgccgcgcccggaagtcacgccgcgaaacgcactcccagggtcagatcgaacgctctttcgaacatccgttctaactacatcagagactaacacccgcctacgacaaaaccgcaaccttcagagcgccacgccacccactttttcgaacagatgatcgacaccgaaccggccgagcggagacgcgatccaccggaaacggcagccggcaatcgacggcaaacaccgaggccgcaagcaactggatgcgggcgcgggcgggcgagctagctagctaggcaggcgggcgcgggcggctggaaagaagcggaacgatcagaccgaggccgcccgcacgacactctcccccgccggagtgcgggtgtagagcacgctccgccccgcccgccgccgcatcaccagccccgcctccagcagcaccctcagatgccgccccaccgaccccagccccagcccggtgatcgccaccagctggctggtgctcttcggctgcgccagcgccaccagcaccccggcccgcccggccccgagcagccgttccagcgcccccggcgccgcccgtcccggctcggccagcacgcccgacgcccgatagatcagcgcgtaccgggtcggatccggattctcccaggccgcccatccgcggcccagcgtggtcggcacgaagagcagctgcgccccggagatgtcgcggggcggatagtcgtacgcgttgatctgcagccgcccgccgcccagccaccgcatcccgtcgcgcatcccgttcagcgcggcctgccagccgccctgggtgagctgccgggtccgggccagcacgtcggcttccaggatccgccggcgacggggccagtccggcgcgatcgccgtctgccagagccaggtcagcagcccggccatccgctcgccgaggtcgtcccggtcaagctcagccggcaagccggccaggctgcgcgtaccggaatcctcccggtcaagcccggccgaggcacgcacccccggatcctcccggccaagcccaaccggcagcccaccggccaatccctccgcgatgtgctgccgggccgccgccggcacggtggcccggatcaccgccacctccgccgcgaacgaccgctccgcgatctcgggcggcggcgccatgaagtcggcgatccagtgcggccgcagcgccgcgtccaccagccgcgcggtgatcgggtcggcggccagccgggcccggtaggcgggccggtgggcgcgcagccagggccggtcggccgggtgctccgcgctgtcccagcgcagccgcatcagcccggcggtcgtctcggccagcggcgacagcacgaaccggctgccggccagggtgtcggcgtcgatctgccaccagcccacccgggtccacctttcgccgctgtgcgaaacattaacggccgggcgggaccggcccgaagactgacgaaccatgcgcacctatcgccagttgttccgcgtgcccggtttcgccccgctgttcgtcacctcgtgtctgcagaacgccgcggtcacggtggccgggctggccctggccaccggggtctgggaccgcaccggttcgccgctgctcgcggcgctgagcatgttcggtccgtcgctggcgcaactggccggcgcgacgctgctgatgtcggccgccgaccggtggccgccgcgggccgcgctgaccggggtggccgcgctgaccggtctgctgaccgcggtgttgagcgtgccggacctgccggtgccggcgctgttcggggtgctgctcgcgacgggcctggtcgcctcggtgggcggcggggtccgcaacggcctgctcaacgatctgctgccggcgggcggatacctgctgggccggtcgatgctgaacgtctcggtcggggtgacgcagatcgccggattcgcggccggcggcgcgctggtggccgtgctgtcgccggaccggaccctgctggcggcggcggccctgcacctggtggcggccgggctggcccgggtgggtctggcccgccgcgctgcgcgcgacccgggccggttgtcggtcgcggcgacgatgcgggtcaacgcgcggttgtgggcgatttccggcgtacgtccgatctttttgggcctgtgggtcccgaacggcctgatcgtcggctgcgaggcgatgttcgtgccgtatgcgccggccggggccgggctgctgctggcggcctcggcgctgggcatgctggccggcgacgtgctggccggtcgcctgctgccgccggtgtggcggcgtcgcctcgcgccgtttctgcgactgctgctggccgtgccgtacctgccgttcctgctgcatccggcgctgccggtcgcggtggtgctggccgcggtggcggcggtcggctactgctcgacgctgctgttgcaggagcgtctggtcgagctgaccccggccgagcaccggggtcaggcactcggcctgcacgcctcggggatgctcaccatgcaggcggtcggcgccgcgctggccggcacgctggccgagctgagctcaccggccgtcgcgatcagcgggatggccggcgcctcggtcgcggtcaccctggcgctggccggcccgttgcgcgcgacggccggccgggaaccgacgcccgcgacggcagaacccacggcggcggcagaacccacggcggcggcgtaacccacggcggcggaccggcggaggtctgcggcgtggcgggtgggctcacggcgtacccgctgatcgtctctcagccgacatggacccgcggccgcttgtcgggagacgcctcggtctggcgcaggatctcccgcaccaccggcgcggtgtcgccgcgcccgaacagcagatagcggaacaggtggccgagcgggctgccctcggcccactcgaagtagcagtgcggccgcaccccggtcgcgtcgcggagcgcgagcagcaccgccgcgatcgcgttgggcacggccgggctctgcacccgcaggatccggtgcgacccgacctcgatcccgtgcaccgccaggacctcgctgaactcggacgggtcgaccacgtcgacctccaggaagaggatgtcggcccggccgggcaccgggttcatcccgcgctgctcgccctctttcaccgcgtactccgcctcgtcgccgtcctgacgctggttggccacgatgttcagctcgccgtcgtgcctgatcgagtcggcgatgaagcgccgggccggctcgtcgaattcgatccgctcggcgcgcagctcggtggtccgggtgacccgggagatcagcgagaccaggatgatcccggcgatgaagaccgcggagatcgcgatgccgtccggtttctcgatgatgttgtcggccagcgcgtagagcagcaccagggtgagcacgccgaagccgatggtggcgccgcggtgccgggcgcggaaggccgagatggtcaccgcgaccgcgccggagaccatcatcgccaggatgccggtcgcgtacgccccggcctgcgcgttgacgtcggcgccgaaggcgatcgtgatgccgatgctgatcaccgtgtagaccaggaccaccggccggaccgcgcggccccactccggcgccatgccgtagccgggcaggtagcgcggcacgatgttgatcaggccggccatcgccgaggcgccggcgaaccagaggatcaggatgctgctgatgtcgtagacggtgccgaagacctcgccgagtttcagatgcgcgagatacgccagggcccggccgttggcctggccgccggcctcgaactccttctgcgggatcagcaccgtggtgacgaagctggtcgcgatcaggtagacgctcatgatcgcggcggcggtggtgagcagcttgcgggtgttgcggacccgcgcctccccgtccgccgccttgatcagcggcatcatgctgaccccggtctcgaagccggagagcccgagcaccagcgccggaaaggcgaggaccgccgggccgaggacgtcgaagaagccgctgccgtgctcggtcagccggtcggtccacgcggacagcgcgcccggggtgccgaacacgtcggccaggccgaccgccgtgatcaccgcgttgagcagcaggaagatcgcgaccagcgggatcgcgacgccgaccgcctcgctgaagccgagcaggaagacgaaaccgaggatcagcagcagcaccacggtgatcagcacctggtggccgtgcagggcggacgggagattggggttctccgacatgtgcacggtggcgtcggccgcggacagcgtgatcgtgatgatccacgacgtgcagacgaagccgagcagcaccagcacgaagatcttgccgcgccagaacggcagcaggtgctccaacatcgccaccgagccctgcccgtgcgggctctcccgggcgacccgccgatacatcggcagcatgccgagcagggtcagcgccacgatcaacagggtggccaacggggacagcgcgccggccgccagcgccgcgatcgccggcaggtaggacagcgtggagaagtagtccacaccggtcaggcacatcaccttccaccaggcctgctcgtgggccggattctccgactccgggccgaccggctgcacccggtgggccagcagccatttcgacaggggccgctgggacatccgctcgcgaaccggcgccaccaccgccggaacgttgatctcggtgctcatgccaccctcttcctcgtcacgtgcagatgtcaggatgcactagggatacgacagtccgcgtccaggaggcgtcatgacacagaccatcgtgatcaccggggccagctccggggtcgggctggccgccgccgagcagctcgccgcccgcggtgacgaggtggtgctggtcggccgcgacccgggccggctcgacgcggccgtgcagcgggtccgggaggccggcggcggccgcgcgccccggcacttccgggccgacttcgaacggctcgacgacgtgcgggagctcgccgccgggctgctggccgagctgccccggatcgacgtgctggccaacaacgccggcgggatcatcaagcggccccggcagacggtggacggccacgaggccaccatccagggcaaccacctggccccgttcctgctcacccacctgctgcgggagcggctgaccgggggccgggtggtgaacaccgcctcggcggcacacgtgcagggccggcccggcacccggttcaccgacgacccgaagtcgtacagtccgtggcgctcctacggggcgagcaaggcggccaacatcctgttcgccgccgaggccgcccgccgctggccggacgtgtgcagcgtctcgttccaccccggtgtggtgcgcaccaacttcggggagggccggctgatccggctgttctaccggtacgcgcccggcctggtcaccccggaggccgccggcgagctgctgacctggctgtgcaccaccccggccggggagctggagaacggcgcctactacgtcaagcgtcaggtgacccggccggccgcgcacgcccgcgacccgcggctggccgccgagttgtgggacgccagcctgaccgcgaccggcctcgccggatgacgcacgtcgccctgcacgtctggcgggtgccgcgcagcgccgtcggctcggccatgctgcgcatggccttcgcgcggcgccatctggccggtctgcggttcggcaagttcctcggcaccggcaccggcaccggcttcggtcccggcgacaccgatctcacccggtgggcggcgatcacggtcagtgatgcgccggtacgtttccccgtctgggagcggatcgccgtcaacggcgcccggatcgatctggagccactgatcagccggggcacctgggccggccgtaccccgttcgagcccaccggccgccgcccggacggtccggtgctcgcgctcacccgggcccggctgcggccggctcgcgcgctgaccttctggcgggcggtcccggcggtggtgcgcgaggtgcaccgggcgcccgggctgctcgcccggttcggcgtcggcgaggcgccgatcggctggcagggcaccgtcaccgtgtggcgggacgcggcggatctcgtcgcgttcgcgtaccgtcagccggagcatcgcgcggcgatcgcccggaccccggccgaccgctggtacgccgaggagttgttcgcccggttcgcggtgctcgggatcagcggtgaccggtccgtgctgggctggaccgccgacgaaggggaacgggcggaagcatgaggcttgtggcgtggcagccggacgacctgctgcggcggctcgacgacgtggtcggggtctacggcgaggcgatgggctaccgccaggagctgctgcagacccgccggggatacatcgggtcgcacgtgcgccggcccgggttccgggcggtggccacgctgaccaccgagggccggctgatgggcttcggatacggctacacctccgccgccggccagtggtggcacgaccaggtccggttcgctctcggcgaggacgaccgccggcagtggctgaccgactgcttcgaggtggtcgagctgcacgtgcgcccggccgcgcagggccacggggtgggcgcccggcagctgcgcgcgctgctggccatggccaaaggccgcaccgtgctgctgtccactccggaggccgacgagcaggcgtcccgcgcctggcggctgtaccggcggtacggcttcgccgacgtgctgcggcacttctacttcccgggtgacgagcgggccttcgcggtcctcggccgcgagctgccgctggccgagcgtccgctcgaggacgcaccgggcatcgccggcgcctgaccggtgtctccccgtcatctgccctggggcctgctcggggcgctcgtgctcgcccagatctgctatccgctcaccgagggtgacacccgggccgggctgaccgtgctcaccgtgctgctcggcgtcgcgttctcgctgagccacgcgctgctcacccggggcccccgggcgctcacggcgctgctgtcgaccgccaccctgggcgggttcgcggtggaggcgatcggggtggccaccggtttcccgttcggttcctacgagtactccgggcgtctcggtccgcgcctgctcggcgtaccgctgatcatcccgctggcctggacctggatggcctggccggcctggctcgccgcgctgcgggtgacccggcggcggctcccccggatcctggtcgccggggccggcctggccgcctgggacgtcttcctcgacccgcagatggtcgccgaggactactggcggtggcggcacccggtgcccgcgctgcccggcgtgcccggtgtgccgctcggcaactacctgggctggctcggcttcgcgctgctgctgatgaccgcgctggccgccgtcgccggccgggccgccgaccggccgctgtccgccgaccggccggcgctcgccctgtggatctggacgtacgcctcgtcggtgctcgcccacgccgtcttcctgtcgctgccggcgtccgcggcgtggggcgcgctgatcatgggcgccgcggtcctcccgctgctcgcccggctgcgcgcacccgcatgatcgtcgcctggctgatcctgccgccgctgctgctgatcaccgcacacaccgccgtcaacgcgctgctgctgcgccgcccgcgccgggcggcgaccagcaccgaacgggtcgccgtcctgctcccgctgcgcgacgaggccacccgggtcaccccgtgcctgcgcgccctgctcgcccagcgcggcgtcgccgatctcaccgtgcacgtgctcgacgacggctccaccgacggcaccgcggacgtggtccgggcggtcgccggcgaccgggtccggctgcacaccggcactccgccgccgcccggctggctcggcaaaccggccgcctgccaacggctcgccgacctggccggggacgtggacgtgctggtcttcgtcgacgccgacgtggtgctcgcgccggacgcggtggccggggccgtcgatctgctgcgccgggccggagcggacctgctcagcccgtacccgaagatcgtcggtgccggccggctggtccagccgctgctgcagtggtcctggctgagtttcctgccactgcgcgcgatggaacgctcggcgcggccgtcgctggccgccgccggtggccagtggctggtgctggaccgggccggttaccggcgagccggtggccacgccgcggtgcgcggcgagatcctggaggacatcgcgctggcccgcgcggtcaaacgggccggcgggcggatcgccctggccgacggttccggcctggccacctgccggatgtacgagtcctgggacgagctcgccgacggatacgccaaatcgctgtgggcgtcattggggtccgcggccggcgcgaccgccgtcacgctcctgctgattctgctgtacgtggtgccacccctgctggcgcccttcgccccgcttccggcggtgctcggctacctgctcggcgtgaccggccggatgatcgccgccagggccaccggcggccgcgtcctgcccggcacgctggcccatccggtctccatcgtcctgttcggctacctgatcgcccgctccttccggctgcgccgggccggccgcctggcctggcgcggccgcccggtgccctgagccggctgcccgccctgacacccggaccgccggtgcgggcccggccgggcggggacgagggggatcacggatcatcgggggatgagcgacatcgtggtggtcggggctggggtcggcgggctggccgcggcgatccggctggccgaggcggggcatcgggtcagcatccatgagcggtccggcgtggtcggcggcaagctggcggcatacgagagggacggctaccggttcgacaccggccccagcctgctcaccctgccggacgtgttcaccggcctcggtctggacctgcgcccggagccgctggacccggtggtgcggcacttcttcccggacggcacggtgctggactcgtcgtcggaccacgagaccttcctggcccggatcaccgacgcgctgggcggtgccgcggcgcgcgactgggaccggttctggcgccgtgccgagcggatctggcacgcctcctgggagtcggtgctgcgccgcccggtgaccgcggcgtcgctggcccggctgtcctggcggctcggtgacctggccgcgatcgctcccggccggtcactgcggtcgctgggccgccgctatctgcgcgacccgcggctgcggatgctgctggaccgctatgcgacgtattcgggcgcggatccgcggcgggcgccggcggcgctggccgcgatcccctacgccgagctggcgttcggcgggtggtatctgccgggtgggctggtcaccctcgcggaggcgctgctcgcccgatgcgagaaactgggcgtacgggtgcatctgcactcaccggtcgcctcgatcgccacgaccggcgcccgggtgtccggggtccggctgggggacgggacccgcctcgcggcggacgtcgtcgtctccaacgtggacgccgtcacgctctaccgggatctgctgcccagtccgaaaccgctggcccgcctcgccgaccggagcctggccggattcgtgctgctgctcgcggtgcggggcgagactccgcggctggcgcaccacaacgtgttcttcccgcgggactacgacgccgagttcgacgcggtcttcggggggccggggcggcgggcgcggccggccggcgacccgaccgtcttcgtcacccgggccgcggatccggcggtgcgcccggccggcgacgaggcgtggttcgtgctggtcaacgcggcgccacacggcacctcgtggtccaccgtggactggctgcgggcggggctggccgacgcgtaccgggatcgggtcctcgaggtcctggcggggcgcggtctcgacgtacgcgatcggctgatcttcgccgagacccggaccccggcggatctggcggcgtcggccgcagcgccgggcggagcgatctacggcaccgccggcggcctggtccggccggcgaaccgcgcgccggtcgacgggttgttcctggtcggcggctcgacgcatcccggcggcgggctgccgatggtcaccctctccgccgagatcgtcgcgggcatgatcggatcgaactgaccggcgccgccgggtgcactagtgggtgtgtgcggcgaggaaggcctgggcgatgccggcggccaggtcggccgggttcttgacggtgaccgcctggccaccggtggccttggccatggcctgcagggcggtggcgttcgcggccgggccgtaaccgacggcgatcaccggcaccggcttggcggggtcggcaccggcggtcagcttcttcaggaagtccgcgttggacatccggtacttcgtgccgccgtccgagccgtcggtgaggaccaccaccacggtcgccgtgtccggcttggcccggccgcgcatctcggcgacgccgtccagcacgctctggtagagcggggtcccggcgttcgccaccggccggtactcgccgatcttggcggccagcaggtcacggcggctcttgccgtcgacggtggcgatgaccgggccgaacggcacctcctcggtgtgcgccgggctgtccgccgtcggggtgccgaagaaccacaggccgaggctggtgtcgtcaccgaagagctgggccgcgctggtcccggactcgcgcagcagcgcggccttggtgacgctgcggccggcccggtcggtgatcttctcgttcatcgagccggacgcgtcgatcagcagcagcacctggaaggccaccgacttgtacgccgaccactgccgggccgccccggcgagcacggccggggccggcaggcgcagcgcgttcttggtcgcggtggcccggaatccggccgtcgtcagcgcgtccggggtgatcgcctcgcgaaggctctcgaccaggtcggccggggcgcccttgcggaccgcgtacggatagtcggcgtcgatctggccgtcggcgggcgccgagccggacagccggacgtcgtgctgactcttctgataggtcagcagctgctgctcggtggtcgggaagaccccgacctggtagatcgccgtggccgcgtcggtctgcttgcccatctgcgcgaacagttccgccgggtcggcggccgcgttctccagccggctgcgcagggtgagcgcctgcaactgggcgatcccggcgtccgggttggccttgaccgtggcctggcccaccgcgtagacgctgagcagtccggtcgtggtcagcgtcggatcgggcatccggaccgccggcacccgtttctggatggtgccctggaccaggccggaccaggaggtgaccccgttcggcgcgaacaggctggcgatcgactccggcccggcgatcaccagcggcgaccaggccagcgacgcgccctgcgtggtgtagacgtcgccgcggcttttggccagggccagccacacgctgctggacggcacccagacgtccggcttgccggtcagcgcggcgcccggctcggcggcctgcaccagcacctcggagcagcgctggccgggctggctgagtgcggcggcggcctgctggatcaccggggcgatctccggcgcggcggcgacccgcaggcgcggctgtgggcagggtggcgcggtctgcgcggtgggcgtcggggcgggcgcggtgggctgcgccaccggcgtagcgccgcggctgctcatcagacgccaggcgatgccgccggcggccagcaggaccagcaccaccaccgcggcggccagcagggcgcggccacggccgggtggcggctcgtgatgcggctggctccactcgccctggtcgggcgggcgggggtcgtcgggccactcgttctcgggcatgccacctcgacatcgcgtgaaattcgacaactatctaaaagtcgagaccgatggttgcggatagtagtcccggatttttgtcccgcaatggttcctaaggttccgcacaacatctcggcacatctgtgaccgtcaggacatcagccggggcgtcgcgaccgcgatcacgatgaactcgccgtcgccgctcagacccaccggctcgcgcccccagccgccgtagatccgctcgacccggaagcccgcctcgcgcagtgagtcgcgcagctccggctcggtccggaaacgcagggtcgccgagttcgccagttcccctccgtcggcgaaccggtagcgcccggtgacgcgcacggtgttcagcccgacctgctcggcctcgctccacgcctccaccaccctcccgtcgtcgagcaccacggtgcgccacgaatcctgcgggttccactgctgccacggccggtcgtccgggtcccggctgtcgaagaccagccgtccctccgggaccagcgcccggcgcagcccgcggagcacggtgtcccattcctcgtcgtcgacgaaggactgggcgacgtgaccggtcatgaacgcggcgtcgagcgagcgcggggcgagccgctcggccgagccctgcagccagcgcacccgggtgccgcccggcttgcggcgggccgcggccagggcggccggcgccgggtcgatcgcgatcacctcgtgcccggccgcggccatcgcgatggccagccggccggtgccgcaccccaggtcggcgacccggtgcgcggagcgttcggcgagcacggccatgaagaagtcgtcgtcccagccccagggacattcggcgtcgtagacctcgacgagtcgcgggtcgtggaactcgcccatccacacatctaggactttaaacgcgtggtgggcaattgactaccctaagtggacggtctctccagggcgcgcacgccgaacggcagccggcccgagccgatgtggtcgagcaccacctcacgcagcgcggccgcggcatgcggcagcaccgcggcacggcgctgggcgagcgcgatggtccggcgcatccccggcggcgcgagcggggtggcccgcagcagcggccggttggcgagcaccatgctgggcaccagggcgaccccgaggccggcctcgacgaaggcgagcaccgcgtccatctcaccaccctcgaccgcgaacttcggcgcgaagccggcccgctcgcaggcgtgcagggtgacctcacggatgtcgtagccctcgcggaacatcaccatcggggtgtggcgcagctcggagagctccagttggcggcccacggtgggcggcgggccggccgcgaccgaggccaccaccaggctctcgcgcagcagctcgatggccaccagggccggatcgacgccgtgctcgggctgcacgatcagggccagatccagggtgtgcgccagcaggccggcggtcaggtcgtgcgagctgccctcactgatgtgcagcttgacccccgggtggtcggcgcggaaggtgcgcaacacggccgggaccagcgaggagcacaggctcggggtggcacccaggcgcacctcgccgcggcgcagaccgacgatgtcctgcacggcgtcgcgggccgcgtcggcgtcggcgacgatccgctgggccatcggcagcaatgtctcgccggcgacggtcagggtcaccgcaccgcgcatccgctcgaacagcggggctccgagtgacatctcaagggtgtgaatctgcttactcaaggtaggttgcgagacgcccagaatgtccgctgcttgggtgaaatgccgggtctccaccaccgccaggaagtaccggagttgttgcagctgcaccgtaatagcctatcgctatgagtacccggccgatcatgcattagacgaatgacccaggacttcctaacgtccaggttgtggcggtagacactcctattcccaagaccaagaacgcggcgggggcgacggcaacgcccaccccgcgcaaggtcgtccggccctcgtcggtgaccctgaagatcatcatggcggtcagcggcatcctgctggtcctcttcctctacgttcacatgatcggcaacctcaagatcttcttgggtgccaccgacttcgaccactacgcgcactggctgcgcgcgctcggcacgcccctgctgccggacatgtggtacctgtggatccagcggaccgtgctcaccgtcgcggtgatcgcgcacatctggacggccgccgtgctgaccatccgcgccaagaaggcgcgcccggtcaagtacgcgcaccggcccaaggtgcagggcagctacgccgcgcggacgatgcgctggggcggcgtcatcgtcctgctgttcatcatcttccacatcctggacctgaccaccggcacggtgaacccggtcggggaccacgagcacccgtacgcgaacgtggtcgccgacttcgcgccgcaccgctggtacgtgacgctcttctacgccctggcgatcgtggcggtcggcttccacctgtggcacggcatcttcagcgcggcccgcaccctgggccagcagaccatgcggggccagcggcgcgccaagacgatcgccctggtgctgtcggtggttctggtcgtcgggtacctctcggtgccgttctcggtgctgaccggattggtggactgaaatggctgagacggatttctggaaagagggcgacccggtcgtcgacaaggccgccccggacggcccgatcgagacccgctgggagcgccgcaagttcgccgccaagctggtcaacccggcgaaccgccggaagctgacggtcatcgtggtcggcaccggcctggccggcggctcggccgccgcgaccctggccgagcagggttaccacgtcaagtcgtactgctaccaggacagcccgcggcgcgcgcactcgatcgccgcgcagggtggcatcaacgccgcgaagaactaccgcaacgacggcgactcggtctaccggctgttctacgacacggtcaagggcggcgacttccgcgcccgtgagtccaacgtgtaccggctggcccaggagtcggtgaacatcatcgaccaggccgtggcgcagggcgtcccgttcgcccgtgagtacggcggcctgctggacaaccgctcgttcggcggcacccaggtgtcgcgcaccttctacgcccggggtcaaacgggccagcagctgctgctcggcgcgtaccaggcgctggagcggcagatcggcctcggcaacgtcgagatgaacacccggcacgaaatgctcgagctgatcatcgtcgacggcaaggcccggggcatcgtggtccgcgacatgatcaccggcgagatcaccaccgagctcgcggacgccgtggtgctcgcctccggtgggtacggcaacgtcttcttcctgtccaccaacgccatgggctgcaacgtcacggcgacctggcgggcgcaccgcaagggcgcgctgttcgcgaacccctgctacacgcagatccacccgacctgcatcccggagtccggctcgcaccagtcgaagctgaccctgatgtccgagtcgctgcgcaacgacggccgggtctgggtgcccaaggcgcagaaggacacccgccgcccggcggacatcccggaggacgagcgcgactactacctggagcgcatctacccgtcgttcggcaacctggtgccccgcgacatcgcgtcccgggccgccaagaacgtctgcgacgagggccgcggcgtcggccccggcgggctcggcgtctacctggacttcgcggacgcgatcagccggctgggccgcaaggcggtcgaggcgaagtacggcaacctcttcgagatgtaccagcggatcaccggcgaggacccgtacgagacgccgatgcggatctaccccgcggtgcattacacgatgggtggcctctgggtcgactacgacctgcagtcgaccatccccggcctgttcgtggtcggcgaggccaacttctccgaccacggcgccaaccggctcggcgcgtccgcgctgatgcagggcctggcggacggctacttcgtgctgccgaacacgatcaacaactacctcgcggccgggccgttcaagaagatcgcgaccagcgacgaggcggtcgtgtcggcccgcaaggaggtcgaggaccggatcgccagattcctgtcgatcgacggcgaccggaccgtggactccttccaccgcgagctcggccacatcatgtgggagtactgcggcatggagcgcaccgaggaggggctgaccaaggcgatcggcctgatccgggcgctcaaggaggagttctggacccgggtcaaggtgcccggtaagggcgaggagctcaaccagaacctggagaaggccggccgggtcgccgacttcatcgagctgggtgagctgatgtgcatcgacgcgctgcaccggcgggagtcctgcggcggccacttccgggccgagtcgcagaccccggacggtgaggcgctgcggcacgacgacgagttcggttacgccgcggcgtgggagtacttcggtgccgacggcaagccgaccctgcacaaggaagagctcgttttcgagtacgtccacccgagcacgcggagttacaagtaatggacatcaaggtcagggtgtggcgtcagtccggcccctcctcctccgggaagatggtcacctacgacgtgaaggggatctccccggacgcgtcgttcctggagatgatcgacgtgctcaacgagacgctgatcctttccggtgacgacccgatcgcgttcgaccacgactgccgcgagggcatctgcggcgcgtgcagcatggtgatcaacggggtggcgcacggcccggagaaggccaccaccacgtgccagctgcacatgcggcacttctcggacggcgacgtgatcgacgtcgagccgtggcgtgccgccgccttcccggtgatcaaggacctggtcgtcgaccgcagcccgctggacaagatcatccaggccggcggttacatcagcgcgcccaccggcaccgccccggacgcgcacgccgccccggtcccgaagaaggacgcggacgcggccttcgaggcggccacctgcatcggttgcggcgcctgcgtcgcggcctgcccgaacggctcctcgatgctgttcaccgcggcgaagatcacccacctcggcctgatgccgcagggccagccggaacgcgacagccgggtgatcgacatgctgcaggcgcaggacgacgccggtttcggtggctgcaccaacatgggcgagtgcaccgaggtctgcccgaagggcatcccgctgagcctgatcggccggctcaacagcgactaccgcaaggccgtcgccaagcgctgaccgccggccggtggggtgcctggtgccccaccggcgctccactccaggtgtccggcacaacggcgtgccgggcacccggtccctctcgcggcacatcgacggtcgccgggacccgccgcgctcaggccgtggccgcggcgatggccatggtgtgctgatactcccgccagccggccagcaccccgtcccgggtacgcagcaccccgatgaacggcgcggccgcccgccgtccgctcaccgtgtgcgtccccaccagctcgtattccacaatgatcacctcggggtcaccggtctcgtggatcaccaccgcccggcagtcgtcgaaccgcaccgggaacccggcccgcccggcccgggcctgctccaggacccgctcgcgcccctcggtgcgggtcggccgccccggcgccgcgaacggcgtctcgaccaccacatcctccgcgagcatcgcctcgtcataggtcgcgtcgccggacagccatcgctcgcgcatgcgcacgaagatctcctgcggtgtcaccacacacacctccggttaagatgagtcaaaactcagcttccttcgaccacgatagtgagtggagactcgacttgccaccggatgccgacggtcccccgctgcgcgccgacgcccagcgcaatcgggcacgcatcctggacgcggccgagaccgtcttcgccgagcgcggggcgaccgcgtcgaccgacgaggtggcgcgccgggccggggtcgcgatcggcaccgtcttccggcacttccccaccaagaacgacctgctcgcggagatcatgaaacgcctgctccggcggttgaccgccgatgccggcgagctggccggccgcggggacgggctgttcgagttcttccgccggctgatcggcgaggcggccgccaagcgatcggtggtgcagctgctggccggctcgggtctcgagatccgcctgccacagaccatcggacagctggagtgggcggtcggcggtctgctgaccgaggcgcaggcggccggtacggtggccgccggcgttcagctgcccgaggtgatggccctgctggtcagcctctgtcagggggcgctgcacggcggctgggacgagacgctgcgggagcgcaccctggccgtggtgttcctgggtctgcgggcggcctgagtcccgggcggcgggcgcaggcgccgccgaagccgcggtgcagaaacgtcgtcagcgtctcgatcgcctcgtcgtccccgagttcccggcccagcccgggccgccgcgcaccggagaaccaggcgttcgcgcggccgccgagtggcggatggacgatctgcacgcgcccactcccgaggtgcccacaccctgccggccatgcccggcgcactgcccgtccatcacgtcacggccgccgcggcgctccgcgcttatgatgtacgtcaatccgccctgttcctgatccgtccggacaactacgtcgggtgtgccacggacgacccccgggacatcctcgatcacctgccgctgatcagcggctgacccgcgcggccagcgccacgccgagcgtcagcgcggcgccgatgatcagcggcggccgggcgcccgcgccggacagcgccgacccgagcgggatgcccagggtgatcggcccgaacatgaccatgctgccggtggccccgacccggcccagcagccggtccggggtgccggtctggatcgcggtgatcccggcgatcagcgtccacggcagcccgagtccggtcagcacgctgcccaccggcatggccggccaccagggcagtgcccaggtcagacaggcggccgcgaagagggtggcaccgagcgccgcgacccgggccgggcgcaggcgggcgagcagccggccggccagcagcccaccggcgatcgcaccggcgccctgcagaccggacagcacgccgaggtaggtggacgggcggtgcaggtcgtcgacgaggtgccgcagcaccgcggcgttggtgaacccggagaccgcgatggccaccgccgccaccaggaccggggtgcgcatcggcgcccgccacagctcggtcagcccggcccggacgccgcgccggtcgagcgccgggccggccgccgggaccgcgggcgcggcgcgcagccggaccatggcgtacagcagcgcggtgaccagcgggagcgccgcgcagagcagcagcaccggacgcgggccgtgccaggcatagagggcggccccggccggtggcgcgacgagtttcatgccctcctgggcgctggaccgccagccgttgacatcgccgagcagcccggcgggcagggcggccggcagcagcgcggtctccccggcgtccagcagcacgtagccgatcccgcggacgagcaggaccaggtagatgccggtcggggcggggtcgagcagcagggccaggatcgccaggccgaccagcacgtcgacggtgatcagcagcgggcggcgggggaagcggtcgaccagggcgccgagccagggcgcggccagcaccggggcgtacgtgccgagcccggccagcgcggccagcccgggcgagccggtgaggtcgagcacccagagtccggcggcgagggcgagcgcactgccgccgaagccggagcagagcgagatcagcacgaacagcacggcgttccggcgcacacgtcacctcagacatgagtcggtcggactcagatcctccaaggttgagcgacctggtgtcaatccgggcttgccgcggccaggctcgccgcaagccggtcgacggcggcccgcatcggggccggcaggcgcggcaccggcggcccggacaggtccgcgagagcaccggcaaccaggtcgaacagcgctccgggcggggcgtcgggggcgctcgacaggatctcgcgaaccagcgcggcgcgcgggaaacgggcgtcccaccggcgatcggcaccgatccgtcggtgcagctcggcggcgctctcccgcaaccgggccggcgcctcgccgtatccggcgtcccgatcggcccgcagcggccgggcgccccgctcggcggccctagctagctagggccggccaggtggccccggcccggcgagcctgatcgatcagcgccagttcctcggcgtccagccgggcccgccgctcccggattgcccgcaacgcactgaggtcggtcacgcgtccaccctagggcattgtcaatcaaacgttgacatcaggagctcgataccgtcgagcagccgggccagtccgatctcgaaggactcgtccggcccggcagcctccgcgaaggcgccgtccgcgaccgcctccgccagggccgggaaccgctccgcggtgacgaaccgggccagcagcgccccgtagtcggcgaccacgtccggcaccccgctgagcagcaccgcgctgatctgcgcctcgccgcgcgccaggtagagcgcggccatcaccatctcgccgcggagccggtggctcagtggggtaccggcgaacgccgagaggccccggtccagccaggccagctgacccggttcgaggggcggccggcccgcggtggcctgcaggatccacggatgcgcggcgagcacggcgcgcagcgcgcgggcccaggcggccagaccgtcgcgccaccccggcggcaaccgcggcggctcaccgggcgccgcgtcctgcatgaagaccagcagctcgtccttgttggccacgtgccggtagagcgacatcggcgcgcagccgagccgttccgcgaggcgggccatggagagcgccgcgagaccgtcgcggtcggcgatcccgatcgccgcggcgacgatccggtccaggctcagcgccggctgcgggccccgggtgggtcgctccgccaccccccagagcaccttcaacgtacgcggcaactcgctgaccatcgccccatcgtagggggttccgaatttactgcgtacggcctacgctgaattgcgtaggacatacgcagataaggggaccggcaatgactcgatggtggcggcgcccgtggatcgtcccgctcgcggcgatcgtggtgctcttcgtgaccttctccctcccgccgtatctgagcttcgacccggcccgctcccgggtgccccagccgcccacgctcggcgtcgcgcacttctggctgctggtgccgcacgtgctcttcggcagcgtggcgctgggcaccgcggtggtgcagatctggccgtggttccggcagcggcacccggtggcgcaccggcggatcggccggctctacgtgttcggcggggtgctgccggccggagtgtgcgcgctgacgatcggggcgttcaccccgtacgggccggtcacccgggccagcgacgtcctgctggcgctgctctggctcacggtgaccaccgccggctggcgcgccggccggcgccgccggttcggcgagcaccgccggtggatgatccgcagcttcgccctgaccgcctcgatcatcaccaaccggatctggggagcggtcttcgtgatcgggctgaccccgcggctggacaccacgttccacggcgacgcgggcctgctgacctgggtggcgtcctcggcggcggcgtggctggggtggacggttccgctgctgctcgctagctagctagccgcagagcaggctggcggcggtgaagacgagcaacccggccaggcagatccggcgggtgccgagcaggtcgccgaggcggccggcgagcagcagcaggccggcgaaggcgaccaggtagccgttgatcacccaggccacgccggccggggtgaagccgaggtcgcgctggatgaccgggacggccacggcgacgatggtgctgtccagaacgatcatcaacgcgacggtgcacaggttaaccccgggcgatcgccgcctcatcccacgtgatgccggcgcccggacggtccgcgatccacacctgaccgtcgcgcgccacgaccggctcggtcaggatcggccgggcgtggtccaggtactccaggtaggtggcgctcggcgtgaccccgagcaggtgcgagctgaactcggggaaggtgtggctggacaccggcaggccggcggcgtcggccaccgccatcgcccgtagccagccggtcaccccgccgatcttcatcacgtcgagcatggcgtggtcgccggctcgggccgcgatgcttttggccaggtcggacacgccccaccagttctcgcccagctggatcggggtgacggccgcctcggcgatccgcgcgtgaccggcgaagtcctcggcggtggtcggctcctcgatccagtacaggccctcgtgatcgagcacccggacccgctcgatcgcctcggtcaccgtgaggctctggttgtagtcggccatcagccgggcgtccgggccgatcaccgcgcgcagcgtccggatcaccgcgaggtcgtccgcgagggatcgcccgccgaccttcaccttgaacgcggtgaaccccaggccgagcagttcctgcgcctcggccgcggcggcgcgggcgtccatcacccgcagcgaggcgtacgcgtcgaccggccccggctccccgccgagcagcgtcaccagcggcagcccggcggcgaccgcacgcgcgtcccacagcgccatgtcgatgccggccgtcgccatcccggccagcccctgcggaccggccaaccggaacatccggcgcatcgcccgctcggcggtcagcggggcggcgctgctgcccacgagcgcctcgccgaccgcaccgaccaggctcgccagcgggcccagtgccagtggggtgtagcagcgcacatacgaccgcccgaccaccccgtcccgggtgtggacgtcgatcagcaccagcggggtggtcgccatcaccccgccggccgtctccaccggccggtccagccgcagatcgaccgcccgggcgcggaccgcggcgatggtgcggtcgtcacccaccgctgccgccgtcggcgggtgcgaccccggtgaccgccagcgtctcctgcccgatcatctccggcaggggcacgtcgtcgcggttggccaggatgacgccggcccacccggtgtccgggtagatgctccagttggcgcagaccccggggttgccgccggcgcgctgcacggcccactgaccgccggtgatcgcggcgggcgggccgtaggtgccgaacgctcccggccccagtgggatcttcggcgcggtgagcacgtccgcccagggccggtcgagcagggtgccgtcgcgcagcgcgtgggcgaaccggatcaggtccggtgcggtggcgaaaccgccgtccccgatcgcgtcgatgaaggcacgccccggattccggtcgcggaggtagccgagcgggctgccccggtccaggtgccggaccgcgtcgagccggctgccgtcggccatggtcatgtacgggtgggcgaggcgcgggtcggtgagccactgcggccgggtgaagaacgccgatccggtcatcccgcagcgccggaacacgtgctgctccacgtagtcccagtaggacatcccgctgacagtctccacgatcagggccggaatcaccgtctcggcgccgacgtgctcgcggtcctgctgcccgggaatgccgaccagtctcgactgccgcgcccaccgcagctggtactcgtggacctcggcccggctccggaagatccgctggacgtcctcgtccgggatgctcagcccggaggtgccggagagcaggtgatggatggtcaccgtacgggcgacgtcccggtcgaaaccgtccaggtggtcgccgaccgtgtcggtcagccgcagccggccctgctgtgccagttgcaggacggcgatcgcgttgaacggcttgccggccgagctcaaggtgaacgcggtgctctcccggatgcggatgccccgctcccggtcggccatgccgtaggcgcgggacagcaccgtccggccgcggtgcgacagcatgaccacgccggagaaccggccctgcgccgcgagccgtgccacgtagcggtcgtaggcgccgccgggaagggtgtccggcggcaaccggtccgcgccggcgcgggtcggcgggccgccggtgaccgcgccggccgcggccagaccgccccagccgagtagtcgccgccggccgaccccggttgccgcgtccactttcctgagcaccattgtccccccgtcgtgaagtcagtctccaccctgcacggcggtccgttgcggcggcgtaagcggatcgctcacgccgccgatatcgggtgtggaaaaaggcggccggcgagtccccgtgtccacccgccggccgccggtccggatcaggcgaaggtcacccaggccggcgcgtacggcgtgacgcgcagcggcatccgcgcctcggccggggtccggtcgcccttgcggttgttgcagcggccgcaggcggccacggtgttgagccactcattcccgccgccgcgcgagcggggcagtacatggtcgatggtggtggccggctcgccgcagtaaccgcaggtgcgacggtcgcgggccagcacgccggcccgggaccagccggggccgcggccacgccgccagcgggtcaccacatagctgaccagtcgcaccacggtgggcacctgatagacgccgatggtcgcgtccggccgcgcctcgtgcacgaccgccacctgacggaacagcatccggatcgcgtgccggaggctgacccggtgcagcggcccgcagtccgcgttcagcaccagaaccgcgctcattccgtttcacccccgtcacatccatattcaccggaatcagcagatcatcggtgaatgactgaggaagaaaataggcgtggcatcgacggccgacaaccgaaataaacggatcagcgaagcgcgcggcgcacggtcgcgccgagctggatcagcccggccagttgcagggcgagccacagggcgggcggcagccagggcagccggaccacggtgatggcggccaggccgagaccggcgatcagggcgcgggtgggccgctcgccgacggtcaccaccccgatgtcggacatgccggccaccgcggcccgggcccggacgtactcgtgcagccagctcgcggcaccgccggccaccaccagccagccgggggcgccggccagccagaacgcgagcagccatgcggcctcgccgagccggtcggcggccgagtcgtacacgaatccgagtctggtcactcgccgggagatcaccgcgaccgcgccgtcgaggccgtccgcgcccgccgcgagcagcacgaacagggcggccagcgggaggctgaccggcaccgcgagcggcaccgccccgcagatcagcagaccgcaggtggtcaccgtcatcggtgacacccggtggcggctcagccagaagccgacccggtacgccgtgagcacccagccgcgcaccacccgggaggctcgtcgcgggtcgaacccgccgtgcagcccggaccaggcgagggcgtactcgtcccaggtcacgccgacgcggcgacttccgcgggggccagccgctgccagacctcgcgggtggcggtggaccggttcatggtgatgaagtggatgcccggcacaccctcccgcagcaaccgggcgcacatcgccgcgcacgtctcgatgcccagctcgcgcaccgccgcgtcgtcgccggcgacccgctcgaagtcgcgcagcagcgccggcgggaagggcgcgccggagagctgggtggagcgcgcgatggtggccatccgggtcaccggcatcacgccggccacgatcggggtgtgacagccggcggccaccacccggtcgcgcagccgcagatattcgtcggcgtcgaagaacatctgggtgatcgcgtagtcggcaccggcccggcacttgcggacgaagttgcgggtgtcgtccttgacgccggccgaccgggggtgtttgtgcgggaaggcggccaccccgacgctgaagtcgccggactcgcggatcagccggaccagctcgtcggcgtaaccgacgccgtccgggtgccggacccactcgcccatcgggtcgcccggcgggtcgccgcgcagcgccagcacgttgcggatcccggcgccggccagccggccgatcacgttgcgcaggtcggccactgagtggtcgaccgcggtgaggtgggccagcggcagcagcgtggtctcggtggcgacccgctcggtgaccgcgaccgtggtctcccgggtggtgccgccggccccgtaggtgatcgagacgaagctgggccgcagcgactccagctcccggatggcctgccagagcagccgctccccgtccggtgtcttcggcgggaagaactcgaaggagaacgtcggcgccgcgccgcggaccaggtcgccgatcgacggggtgccgggcagccgggagggaagtccgagagacacaccggaaccataccgggccggtggacgggcccgcggcggcgaacaagtagcgtcgacgcgtgacgaactccccgctcgacgaggccggtctgcggtcgcgtgtcgacaaggcgctgaccgtgttcctggccgggcagcgtgaccggctgctggcgatcgacccggcgctggccgagatgtccgccacggtctccgagttcgtgctgggcggcgggaagcggctgcggccggcattcgcctactggggtttccgcggggccggcggcgccgactcggacgccgtggtggcggccgtcgccgcgctggagctggtgcaggccagcgcgctgatccacgacgatctgatggaccgctcggacacccggcgcggggtgccgtcggtgcaccgtcggttcgagaaactgcacgccggcgagggctggcggggcagcgcggccgggttcggcgactgcgccgcggtgctgctcggcgacctggccctggtctggtcggacgagctgctgcacacctcggggatggcggtggccgacgtgcaacgggcccgcccgatcttcgacgggatgcgcaccgaggtgaccgtcgggcagtacctggacgtgctcacccaggcgaccggcgacacgtcgctggagcgggccggcaaggtggccgtctacaaggccgcgaaatacaccgtggagcgtccgctgctgctgggcgcggcgctggccggagcggcccccggggtgcacgcggcgtactcggcgttcggcctgccgctgggcgaggcgttccagctgcgcgacgacgtgctgggcgtgttcggcgacccggagcggaccggcaagccggccggcgacgacctgcgcgagggcaagcgcacctatctggtcgcggccgccttcggcgcgctggacgcggccgggcgggccgaactggacgccgcgctcggcgaccccggcctggacgaggccggggtggcccggctgcgcacggtcatccgggacagcggtgcgctggccgcgaccgaggcccggatcgacgagctgatgaccgcgtcgatcggcgcgctggacgcggcaccgatcgatcaggacgcccgggaggtgctgcgccggctggccgacgcggctactcgtcggtccgtctagacccggctcgcggggtgcgctggatgccgcgccggcccagcgccacccacagcgacagcgtgccgagcaccagggcgaaaccgaacagcaggtcctcgaccggggcgtggacgagccgcgggccgaggatcgcggccgggtcgtacatcacgatgtcgcgcccggtcagaatgccgttcgagatcaactgaaagacgaagatgatggggtacgtggcccagaacaccagtcgcccgacgagccgggtccgcaggatcagcacgtcgagcgtgagggcggccagcacgccgagcaccgcagcggtggtgtaggtcactcgtcccccgccggacgtcgcagcacggcccgcacggcctcgaagccgaggatcgcgcagaccggcaccaccaggaagaacagcacctcgtcgaggggcagcccgccgccgaggtagacgccggtgatctgggccgggtcgaagtgccagtggccggccgcgatcgccgccaggtcccacagggtgaagacgaccgccatcggcagcacggccagcagcagccgacgccaccggcgcagcacgttgacccgcaggatcggttccagccacagcgccccggccaggcatccggccagcaccgcgacgtacgacaaatgcctcatggtgtcgatcgtgcgatcagaagccgagggcctgcgcgcggcgcttgatctcgcgcgcctgctgaccgccgagcgcgatcgcggcgctgccgccgacctcggcgtcctcggcgtagagccaccggaaggcctcttcgtcgttgtacccggcgtcgcggagcacgttcagcacaccgggcagatgcttgaggacggtggcgttggccaccagttcggcgggcaccacgcggatgccgtcgcggcggaccgcgagcaggtcgccgtctctgatcatctggtgcaccttgctgatcgacacgtccagcctctcggacaggtcgggcaggttgatccaggcagccggttcggtgatgacgggttcgctcacgcgtacagcgtgccagaccagatcggagaacagttgatgagcctgtggcgaaggatgcgcggtgagctggccggcgcctggcgttcggtcaagtacgacctgtgccgccgcccggctgagggcaccgaggggccggacgtcacctcgaccggcctgagcacgtttcccgggtcgctgatggagtggcgcaccgtgccgccggagaccgacgcccggccgcggcgccgattcgtcgtggttgtcgcgttgtgcgcgctcgggctggtcggcgcgaccgggtcgtatctgctggtcacccgcggtctggcggcggccggcgagcaacccgtggcggtgcccgcgccgtcgccgtcgccgtcgccgtcggcccggctgggcacggtgaccggccggccgcgcccgaccgcgacccaccatcgggccgccccggccaccgccgtcgctccgatcagcccgacgaaggccggaatatcgccggaaagggcgatcaagccggcgccccgccgcagcccggtctgccactgcgtgaccccgccggtgccgaccccgaccgccgcgcccagcagcgagccggcccccagcccatcggtccccaccagcgcttccgcgccgccgagcgcctcggcagaacccgccccgagcacgagcgacgacgccgcgccgcacctccaccatcgttggtgaatttctggatccatccggaagaccaggctgggcggcagcgaatcagtgcaggtcacagccgtttcggtacccgtttggactcagctgtgacatcctgggtcaccctcaccggaaagacacatacacttcacgccgatggacaccacagtcgccgatacgttgatcggcacaacgattgacgggcgctaccggatcaccggtcgcgtcgcccgtggtggcatggcgaccgtgtaccgggccaccgacgagcggctcgggcgccccgtcgcgctgaagatcattcatccgtcccaggccacgaacgtgcaattcgtcgaccggttcaccgacgaggccaagacgatcgcccggctcacccacccgaacgtggtggccgtctacgaccagggtcgccatcagggcctgccctatctggtgatggagttcgtgcagggccgcacgctgcgtgacctgctcgcccagcggcgcaagctgaccgcggtcgaggcgctggcgatcctggagcagatgctcgccgcgatcgccgccgcgcaccgcgccggcctggtgcaccgcgacgtgaaaccggagaacgtgctggtcgccgaggcgcccagcggtggcatcagcgacctggtggacgcggtggtcaaggtcgccgacttcggtctggcgcgggccatcgaggccagcacggtcgacgagtccggccagctgatggccaccgtcgcctacgtcgcgccggagctggtccaggccggtcaggccgacgcgcgcaccgacgtctactcggccggcatcgtgctctacgagatgctgaccggcatcgtgccctacgacggcgccgacccggtcgaggtcgcctggcagcacgtcgacaacgacgtgccggccccgtcgctgctcgtccccggcctgccgcgggcgctcgacgaactggtcgcccgggccacccggcgccatccggcggagcggccgaccgacgccggccggctgctgaccgaggtccaggcggtccgcgacaacctgggcgcgatcaacctgcagaccgccctgatgagccaggtgccggcccgcccgctgggcggcgacgccaccacgatcgtcccggccgtgccggccgccgacgcgaccgccgtggtgccgccggtgccgggcggccatccgccggccggccggcagcgcccgtcctgggcccggttgcccgagcagaccggcaaccggtcggctccgcacggccgggccgccgaggagccgcccggcgagggcttcttcgccgacaagcgccgggtccggctgttctcgctgatcgcggtgatcgccgtggtcgtgctcggcagcacctggtggctcgccctcggtcggtacagcgatgccccgaacctggtgaatctgcccaaggcggcggccgagaacgccgcgtcccacgcccacttcggcgtcttctacggccagccgcagtatgacgacaaggtcgccaaggactcggtggtcagccagaatcccgcgcccggcgagcgcaccgtccgcggtgagacgctcaccctgatcctctcgctcggccccgaggtgcacgcggtgcccgacctcaccggtcaggaggcggccgccgccaagggctcgatcgaggagctcggcctgaaatacaaggagggcaagggggcgtacagcgacaccgtcccggagggcgtggtgatctccaccgacccgaaaaccgggacggagctgaagccgggcgacacggtcaccgtggtgctcagccggggccgcgccccggtcaccgtgcccaacctggtcgggatgaacatcaacgacgcccgcagcaagctgcaggagctgggcctgtccgcgctggagcgcaccaggcagagcaacgagccggccgaccaggttctcgcgcagaccccgaaggcgggcgccggcgtggagaagaacgcggagatcaccctggacgtcagcgccggcccgccgcaggtcaccctgcccgacctgaacaaccagaactgcaaccaggccaagggcacgctggagggccaggggctgcaggtccaggtcaacaacctgaacccgctgaacccgaacgcggccgtgcacgggcagaacccaggcccgaacacgccggtcgccccgggaagcacggtgcagatcacgtgctactagaccggcggatcgggtcgcacaccaggacgtcgggcgggctggccaaggccgccctgccctacgccgacgcggccggctcggaaaccctgcaggtgtacgtcgccaactcccgtggctgggcgctgccgcccggcgacccgaagcaggacgtgctgttccgcgacgggatcggcgagcgcgggctgcccgcctacatccacgcgtcgctgctggtcaacctgggctcgccgaccgttctgacggtggagcgctcgctcgccgcgctggagcacgcgctgcgccggggcagggcgatcggcgccaccgcggtcgtctaccacgccggcagctcggtcgacgaggcgcacgccgagaaggccatgcaccagctgcacgagcagctgctgccgctgctggagacggccgccgccgaaggcctgccgcgcctgctggtcgagccgagcgccggcggcggccgcagcctggcctccaaggtgcaggacctggaggcgtacctggccgccgtcgagggccatccgtggctcggcgtctgcttcgacacctgtcacgcctgggcggccggccacgacctggccaccccgggcggcatgaccgagacgctggacgccctggtcaccgcggccggcccgggccgcctgcagctcatccacgcgaacgattccaaggacgcctgcggctccacgcgggaccgccacgagacgatcggcaagggcacgatcggtgccgccccgttcgccgagctgttccgccacccggccacggccggtgtcccgatcatcgtggagacgccgaccgtcgaccacgagggccacgccgccgacatcgccctgctcaagaacctgcgcgacacctgagacgccgcgaggtccgctcgcctcccggtccgcgcggcgccgcggctcgtggcgccttccgcacccttgcgcggtacgtgcggggagccgccgccgcgccacgaccaccgctgaacggtcgggacgaggccggccgcgccgacctcgtcccgttgctcagttgtccgtgtagttgaagaccgaggctgcggtgaagtggctctgcttgccggtgccggaggtgaaggtgatcgggaccgggccgggatcggtggccgccggcaccgtgcactggaaggagaggctggaaccggagccctgcttggcgcagtcggccgggtggtcgccgaagctgaacgaggtggcgttgcccgcgtcggcgccggccacccggaccaggaccttggtgccgccggccagcgtgtcggtcttcgccgacaggttggtcaccaccggggcgatgctcaccgtggcctcgtcgcccgggatgtcgtcatgggtgacggtgagcgttgcggtatcggtgagccggggcggcatcacgaccttgacgtggctctcgtcgacccaggtggcggtgagcgccttgcggtcgaggcgcaccacgatccgctcggcggtgaactccttggcgctggcgccgaccgtgccgcccttgatcttcagcagcagcggaccgccgctggccttggcggtcgggtcgtcggtggtgtcgacgctcagcgcgccccggtagttgaccttgccgccgccgctcacctcgctggtaccaccgtcactcttgacccgcacggtcgccgggccgttggccccctccggggcgaccgcggtgatccgggtggccgagaccacggtgatcgcggtggccgggacgtcgccgaaggtgaccgcgcccggggtgtccgggtcgatgccgagaaagccgttgccgttgatggtgaccagcgcaccgccctcggagctgatcttcgacggggagaccgagacgacgcccgggtagtaggcgaccaccgcgccggacatcggcccggccgcccccttgcggaacagctgcatggtggcgttggtcgccttgccggtggccggtgcggtgatcttgaggtgggtctcgtccacccaggccaccccggccgagatgccgccgatccgggcggcgatgtgcagcgcgccgaacgccgccggggtggcgcccacggtgccgccggtgaccgtcaccgggatgaccgctcccccggtggccttggccgggaacctgtcggtgaattccgcgccgagcaggaccgggtcggtcgagccggcggcgaacgcgccggactggctggccacgccggtggccaggacggcggccgcgacggcggcgccggccacggcacgggacttcttcgagtacgccatgctgctgctcctggtcagtcgataggtcagtcgatgggtcggaggtgggtcggacggtggacggccgggcgggtcagtcgatgtcggtgtagctgaacgaggccgccggggtgaaccggctcgcggtgccggatccggaggtgaacctgacccacaccggcccggccgcggccgccgccgggacgacgcaggtgaacaccaggccggagccggagccgctgcccgggcagaccgccgcgtacgtgccgaacaggaagttcgacgcggtcgtcacgcccggcccggccaccttcaccttgaccgtggagccaccgccgaccgtgtcgctgaccgcggagaggctggtcaccaccggggcgaccgggatggtggcgaccggaccggcgaccgtctcctggtagatggtgagggccaggctgtcggtggtcagcaccggcagggtgacccgcaggtgggtggcgtcgacgtaggtggcggtcagcttgctggcacccatccgcacgctgatcccggccgcggcgtagtcggcgaggttcgccccgagcgtgccgccggtgacggtgagcaggtgcactccgccgttggcgcgcagatactggtcgccggcgaaggtgagggcgctgcggtaggcgatccgcgccgcctcggcgctggccccaccgggcgcggtgaccttgacggcggcgtatccggcggcggctccggccggcaccacggcgtcgatctgaccggcggacaccacctggaagtagctcgcgtcgacgccgccgacggtgaccgcgtccgggtccttcgggtccaccccgccgaatccgctgccgacgatccggatcgtgtcgccgccggccaccgcgaccgcgcccggcgtcaccgaggtgatcaccggcgcgtagttgaccgtcgcggtcgactcgggcccggtgaagccgtcctggaccagttgcagcttgctgggcaccgccctggtggtggccggcaccacgaccttgacgtgggtgtcgtccacccaggtgaccttggtggtggggatgccgcccaccttggcggtcaccttgagggcggcgaactgtgacgcggtggagcccacggtggcgccggagaccgtgaccgggatctcggcgccgccggtggccttggccgtcacgctgtcgaagtcggcgctgagcttgagccggtagccgaacatcgaggtgacgttcttgctggtgccggcatcggtgacgaccttgaccagcacgttgccggtgcccggcggggcggtggcgacgagcttggtgtcggagacgacccagatcccggtggccggcacgtcgccgaacagcacggtgctgaggttgtcggtgtcgatgtcctggaacccggagcccacgatggtgaccggcgttcccccgtcgggggcgcccatgagcggcgagatgctggtgacgaccgggaacacgtcggaggcgacccggatcgtgcccgtcgcggagtaggcggcggacggttcggcgatggcgacggccacggtgcccgcgacagcgaccacggcggcggtgagtgcggtggcccggcgggcccgagttgtcttcgtcatagcgaagccatgtatcgggcccgccgggccgaagttgcggaaagtcaggcgagcaacacggtgagcaccgagatcgcctcgtcgacgtcgtcgtcggtgacgtccaggtggaccaccaggcgggccagtttcggcagcatggcggcgatcagcacgccccggcgggcggccgcggcggccagttccggagcgtccagcggggccttggtcaggtccagcgggaccaggttggtgcgcactagggccgggtccaccacgccgagcggcgcgaggccctcggcgagccggcgggcccgggcatggtcctcggcgaggcgctcgacgtggtggtcgagcgcgtaccggccggcggcggccaggatgccgacctggcgcatgccgccgcccatccgtttgcggatcacccgggcccgggcgatccggtcccggctgccgatcaccagcgagccgaccggggcgcccagccccttggacaggcagaccgacagggtgtcgaagagcgcgccgtaactggccagcggcaccccgtcggccacgtgcgcgtgccagatccgggcgccgtcgcagtgcagggcgaccccgtgcgcgtcggccaccgcgcgcaggtcgcgcagtgtgccgagcgggatcaccccgccgccgcccagattgtgggtctgctcgacggcgatcgccgcggtcggcacggaggggaaaccgggcgggcggatcatcgcggcgatccggtcgacgttgagcgccgcgccggtggccgcccaggtgcgggtggagatgccgccgagcagcgcggccgcgcccagctcgtaggtgaccacgtgggcgtcggcgccggccagcagctcgccgccgggcggggtgaccagttgcagggcgatctggttggccatcgtgccggacggggcgaacagcgccgcctcgtgcccgaacagggtggcgacgtgctcctcgagggcgttgaccgtggggtcgtcgccgaacacgtcgtcacccaccacggcggtggccatcgcctcccgcatcccgtccgtcggacgggtgacggtgtcggaacgcagatcaaccacggagcatctccgcgaccaggaaggccagctccagcgactgctgagtgttcaggcgggggtcgcaggcggtctcgtaccggtccggcaggtcgaggtcctcgatgccctgcgcgccgcccaggcactcggtgacgtcctcaccggtcagctcgatgtggatgccgccggggtgggtgcccaggccgcggtgcacctcgaagtagccgagcacctcgtcgacgatccggtcgaagtgccgggtcttgtagccgttggacgactcgtgggtgttgccgtgcatcgggtcacactgccagaccaccttggcgccggtggcgtgcaccttctccacgatcggcgggagcgcgtcgcgcaccttgccgttgcccatccggctgatcagggtgagccggcccgggatgttctccgggttgagcttctcgcacagctcgatcgcggtctccgggctggtgccagggccgatcttgacgccgatcgggttggccagccgggagatgaagtcgatgtgcgcgtggtcgagctggcgggtgcgctcgccgacccagaggaagtggccggagagcccgtacgccttgtcgccggagacccgggtgagcgcccggtcgtactccagcgcgagggcctcgtgcgagcagtacaggctcaccgtacgcagcgcctcgttgtcggtcatcccgcaggcgcggatgaagtccagcgcgcggtcgatctcccgggcgatcgcctcgtaccgctcgccggccggcgaggcgcggacgaagtccttgttccagtcgtgcagcccgtgcaggtcggccaggccaccggccaggtaggcacggagcatgttcatcgcggcggccgagttcgcgtacgcccggatcatccgctgcgggtcggcgatccgcgccgtctcgtccttgtccagcgagttgatcatgtcgccgcggtaggccggcaggcccagcgagtcggtcagcgaggagcggggcttggtgtactgcccggccacccgggccaccttgaccaccggcatcgaggcgccgtacgtcagcaccacggccatctgcagcagcgtgcgcgcgttggccagcaggtggctctcggtgttgtcggcgaaggtctccgcgcagtcgccgccctgcagcaggaacgcccggccctcgcagacctcggcgagcttggcgcgcagctggtcgacctcgtacggcgcgacgatcgacgggacgttggacagcacctcgcagaccgaggccacctcggccatgtccggccagggcggcatctgcacccggggcagctcgcgccaccggtcgaggcccagggcctcgtcctcggcggagtcggtggaggggcgggaggtcgcgactcccgggtgactgagctggtgccactcacggcgcatgggaaaagcctacgaaagaggggcaccgggctgacgcccggtgcccctgtttaccactggatgatcagaggttgcccttgatcgcggtgatcagctcaccgttgctggtgtcaccggagaactcccagaagaaggcgccgccgagaccctggttcttcacgtaggccatcttgcccgcgatcgtcgccggggtgtcgtagctccaccagttgccgccgcagaaggcgtacgcggtgccggccaccgtgccggtcgccgggcagctgcccttgagcaccttgtagtcctcgatgccggcctcgtaggtgccggtggccgccccggtggcggtgccgcccggcgccgcctgggtgacgccggtccagccgcggccgtagaagcccacgcccagcaggatcttgttggccggaacacccttgctcttcagcttctggatcgccgcgtccgagtagaagccgtccttcgggatgccggtgtacgaggtcagcggcgagtgcggggcggtcgggcccttggcgtcccacgcgccgaagtagtcgtaggtcatcgggaagaccaggttcagcttcgcgatgccggacgcgtagtcggccacgtcgagcttgccgccgttggagccgtccgccgagatggcggaggtgatcaggaagttcgtgccgaacctggtgcgcagcgcggtgatcaccttgttgtaggcgtccgggccgctggtgtcgcactgcagaccgcaggcgttcgggtactcccagtcgatgtccatgccgtcgaagacatcggcccagcgggagtccttgaccaggttgtagcaggagtcggcgaacgcggccgggttcgcggcggcctgggtgaagccgccggaccaggtccagccgccgaacgaccagatcaccttgaggttcgggtactgcttcttgagcttgcgcagctggttgaacgagccgcgcagggcgcccgcgtcccaggtgtcggcgacgccgtcgacactctcggccgccgagtaggcgcggtcgtagtcggcgtacgagtcaccgatcgagcactggccgccggtggtgttgccgaacgcgtacaggatgtgcgtgagcttcgcggcggagccggaggtcaccaaattcttgacgtggtagttgcggccgtacacgccccactcggcgaagtagccgacgacgttcttgccaccggtgcccgggttcgacgggctcgacgtggtggtcgacgggctgctcgtcggggagctggtcggcgacaccgtcggggacacggtcggggatgcggtcggggaggtggtgggagtggtcgtgccaccacacgcgccgccgtcggcccagacgtcccactggccgctgtgcgtggccggggactcgttctgggtccaccacttggcggtgtagttatgaccgttctgtgaagcgacgttgtccttcacgtacgcggtgctggcagaccaggcggtggcacacgcggtggccgcgttcgccgacacgagcgggatcgaggccgaggcgccgatcaccaccgcaccggcgagcagcgcccggcggagggttttgcccacgtgggtctcctctaattcttaggaaactttccaaaggaaaagttagagagaccgtagtcacatcgattaacaccagtcaagagtgatgaagacctttaagctccctttaacagagcccaggggatgaacacggcgtgcattcgcacggctacaccgcgtaggctctcgtcatgaccatcttcgacgtcgacattgacgcactcaccggcggcacgaccgatttggaccgctaccgcggatcggtgctcctggtggtcaatgtggcctcgcgctgcggactgaccccgcagtacgacaagttgcagcccctctacgacacctaccgcgaccgcggcctggtcgtgctcggcgccccctgtgaccagttcggccaccaggagcccggcaccgccaccgagatcgacgaattctgccgggccacctacggcgtcacgttcccgatgaccgcgaagatcgaggtgaacggcgccggccggcacccgctctatcagggactcgtcggcgacggcccggacatccagtggaacttcgagaagttcgtggtcgccccggacggcacggtcgccgcccgcttcgcgcccggggtcgaacccgacgacccggagctcgtcgcgaccatcgagaagctgctgccccactgagtgcagcgcgatgagcatccatgtgatcggggtcgacgcgtacgcgctcggctgggtcggggtcgagctccgcgacggcgccttcgggcgcgcggtgctcgcctcgacgctctacgagatcgtcgcgggcagctcgggcgccgcggtgatcggcgtcgacatccccctcggcatgctgcccgaccgctggcgggccgccgacacgctggccgccgaccagctcggcccccggcgcggcagcgtcttccgggtgccgccgcgcgcggtctgggcggagccggacttcgcggccgccaaccggctctgccgcgagctgaccggcgccgggctcagccgtcagtcctgggcgctgcggcccaagctgctggaggcgaacgcgatctgggaacgccacccgggcctgctcttcgaggcccacccggaggtctccttccgcaccatggccggcgagccgctgccgtacgccaagaagacctggagcggccagtcgcgtcgccgggaactgctggcccggcacggcatcaccctgccggaccggctcggcccggccgggcaggcgccccccgacgacatcctggacgcggccgcggtcgcctggaccgcccaccgcgtcgccaccggcaccgcactgtccttccccagcccgcccgaggaggacaacggctccaagatcgctatctactactagacgccctgccgtacgggatggtgcttttcggccattcccgtacctggcgtcgggtttataaactggctccgggagctagtgaataggtggtcgccgatgagggtccagccacggcagcagctgctggagatctggcaggcggtgctcgactactcgttccgggacggccgatggcactggggcggccgcgacgggcgcaattcgatcagcgacgccgagcagctgctctgcattctcggcccggccaccacgatccgggcgttcaccctggaccagccggatcgggtggaggacgacgtgctggacgcgatgcgcgcgctcggcggccggctggacatcccgatcaccctgctccgggtcgtcgaggagtatctgacgacgtacaccgacgcgaccggcaccccgaccttcgcggccgagggctacttccgggtcgccgagacgcaggaggagaagcccagtcccgagcagctggcccagccggtggtcgactcgttcgccatctcgctctcgctgtcgctggccatcatcggtttcgcccgccagttccggagcaatctgaaacgccgcagcgcccgcgccgacatcgacaagctcgaggcgatggccagcaagcggctgaccgccgcgatgatcggcctgctgcgcagcttcacggtggacatcttcgaggtggactcccgcgagggccgcgccctggtccgcacggtgaaccagcgcgggctggccacccgccggatcgtgccgctgatccaggagtcgctgcaggagatccgggccagcctgcgggacgtcacgatgggttccggcgccggcctggccgacgacctggaccacccggaccgactgttcgagtgcggctggagctggggcgtggtccgcgacgcgccggcgatcgtgaccagcgagaaggtcggcgatcagcccgccggtttcgccgagccggcaccgtacatctacttcaccgcgctcgccctggacgccatcgagacgctgctctccccgcggacccggcagctcggcctgctcaacgaggagcagctgcgcctgtcccaggggctgcagctgcgctgggacctcacccagtcgtactggtcgacgatcgccaccgcgaacatcggcggtgcccgctggcccctggaggacatcccctggcagcgcatcaccgagaacgagtcggagtactacagcctgcacgtctcctcgatcgtggtgcaggacctggtccgcaagcgggcccgggacgtcgatctggaccgggtcggcctggtcctggaggagctggcgaaccggtcgcggatcacccgccgggtctacgccggggacaagtcctatcaggtgcacgcgccgggcttcccgatcgagctggggggcagcgacgccgacatcggcccggccctcacgtggtatctgtcggatttcgcaccgctgctgctcaagcggacgatcagcctggccggcctgctcggcgacccggatctgcgcggccggatgctggagctggccgacgagatctggggacagctggacagccggcggctgcccggtgagcgccggcgcgggctctgggaccagcccagcctggtcttcgaggactacgacgtccggtacgacgcgccgtcctggtatcacaccaagcgggtggtcgactgcctggtgaccgcggccgaggtgctcagctcgccgccactgcgcagcacccggctcaccgaccatgccggtgacctgctcagcgaggccgaccatctctacgaccaggagctgctgcagggctcaccgaacgggggtcaggcgatgcgcaccgagttgcaggagctgcagtcccggctccagcgcgcccggtccgtcctggacgagaagccgggcaccgcggccgcgctcgccagtgacgtgctgctgcgcctggaccggttcgccgcggcccgcagcgacctcgacggcgagtcgtgatgctggtcttcgcgacctccgacaaggggggcaccgggcgttcggtcaccaccagcaacgtggcctaccagtgcgcgctgggcggccacgacgtctgctacctggatttcgacttcgggtcgccgaccgccggcgcggttttcgacgtggacaccggcaagctcgtggtggacggcggcggcctgcactcctacctgctgggcacggtggccgacccgcaccgctgcgacgtgttcgccgattcggagcggctgagcatgcgggagcggccgctgggcgcgggccggctgaccctgctgcccggcgacagcggcggcggcgagttccccagcaccccggagatgatccgtcgctgcaaggaactgctggtccggctggatcaggagttcgacgtggtgttcgtggatctgagcgccggccggtcgtacgcgttgcagatggcgctcgccgcgatggccggcgtgcagcccgcgccgaccacccgctggttggtctaccaccgctggacccagcagcacatccaggcggcggccagcctggtctacggcgagcacggcatcctggccaccggactgaccctgggccacgaccgggagcgactgctcggccagctgcggttcgtccggacggcgatggtcagcccagccgcgcagggcctcaccgcggagcaggccgcctgggtcaaggactggaacggtgacctgcagaacctcgcccgggagcgcggcgccggcgcgctctacctgctcggctcggtgccgctggacccggtgctgcagtggcgcgagcagctgatcaccaaccacgacctgacggtcagccggatcgccaaccgggccaccgccgacgccttcgccgagctggcccagctgatcgtcgacgacgacgtgtgggacgaccggtgaccggcccgcaggcacactacgaggagcggtcggcgcagccgcgcgtcgagcagttgccgctggcgcacctctcgatcgagctgggccacctgtacaaggaggatttcgccggcggcatcgagcagttccgccggcacttccggcagatccggccgtacgtggccgccgcgcgggaccgcctggccggcatgctcgagcccgggcgcacgccccgggtcagcacctgcttcatgatcgacgactacttcgaccggttcgaggatccaccggccgcggtcgtcgacgagctggtcaaggccgccgcggagaacgatctcacgatcgactacctggcccgggaggcgggctgcgcccgggccggcgaggtcagcccggccgagctggtcctggaccgcctggtcgccgacccgccgcccggcaccgacggggtgtggcagccgccgcaggagagtggctggctgaccaacggcgactggccgccgggcgccgcggcgccgcccgcgatgagcgcgcgcaccggcccggcccggccgaccgagaacgcgcgcaaccggcattccgtcttcttcgccgtggagatcttctcgacggtgtccggctcgcggctctgggcctgcccccacctggccgcggtgtggcagctgatgcgtctgggcctgttgcgccaccacgggcgcccggtggccccggcccggcccgccggggagatcccggccacctgggccgagatgccggcggtgctgcagctcaacgcggccgccgcgccgttccacgcgtaccggacgcactcggtcctggcccgccggttcctcaacatcgagaccgcggtgggcatcgtgctcagccaggtcgcggtcgacgaggaggtgcggctgcaggtcgcccgccgggcggcgggtgagggcttcgccctgtccgacaaccttctcgagcggatcgcgtacgtcttcgacggcgagacggcccgcctggtctgagcgccgcgcccggtcagcgcggccgggccgcctcccacagctgactgaaccggtcgcgccgctcctcgacccggctcggccgcagcaccagccgggtgttcaccacgatcggcggggcgctctcgtcgatccacgagccggtggtcacctcgtagccgatcaccccgtcgaacaggatgaagtcgaacagcgacgtccggcgcagctggccggccgcggcggagtcgagcacccgcacctccacgccgatgtccgcgtgctgccggtacacctcgtcgagccggtcggcgccctgcgggtcgggccggtccaggatgaagatccggcggacccggacgccgcgctgcaccgcctcccgctgcgcgtccagatagcgctgcccgaggtcggtggaccacatcccgccgccgtcgacggtggtcaggctggtggcgtcgatgcacttctcggccgagcaggtcaggccgagcagccagtcccggtcctccccgtcgtagatggcctcgccgccgtcgccgagctccttgaggaactcggccatccggtgcagttcccgctgggccagccggtgggccagcgcggaggagttcggtccgatccgggtggagtggcggatcagctggctgagcacctcggtctgcaccatcgagtcctccatcagcccgtacagctcggtggcctcgctgatcgcccggaaccgctcgtcgacgcactcgcggatctgccgagcctggtcccgctgaccgatctggacctcgcgcagccggctctcgaagtcgacgaggaattgcacgaccagtgcggagccgccgatcagcacggacagggtgaccgacagtatcgggtcctggtgggccaggttggtcagggcgaaggcgacgccaccggtgatcagcgcgacgccgaccttgcgcaccacctcggacacgcctcgctcgccggggtcgccgttggtggcggacagccggttcacgacgccgccgatccggtcagccggcccagctcccgcagggtgctcagcgcgaggtggtcgcggatgcgctgcacggtggcggtccactgccggccgaagcccgcatgccgctccagctcgtcccagaaccggcgggtggtgacctccagccgggcgcccggcatccagaggtgcagcaggtggtcgagggccggccggatccggtccagcgcggccggcgcgcgcgggccgctcagcggcgcccgggccaccatgccggtcagcgtggtcagcagccagtcgtgcaacgccaggtcctcgcagagggccaccacgccgggcagcgcgtcctcgtcccgggtgtgcacccggacggtgcggcggccctcgccctccacggtgaaccggacgctgtccggctgggtgtcgccgagcatcgccgtccagcgcagcgtgatccgcccgctgcggaacggcacccgggagtcgatcatcgagctgccccggacccgttccgcggtgtgcccggcgatcgccccgaggttgagcagcggcgagacgggcgtggtggcgaggtacgcctcggcggtgtcccgctcccggtgtttcccgacgatctcgacggtgtggggtcgggccagatagtgcgaccaggggagccgcctgttctgctcgctgcgcaccgccgtggtgcgggccgaggactgcaacacgtgaccgccgaccagcaacgcccgggtggtgaccgtcccgatcgcccgggccgtgcgccgggcgccgatcgggacctggcaatccacgccggtcagccggtccggtgagaccacgtacggcatcgggcggtcggtccgcagcacctgcgccccggtggtcagggcgagcagtcgcaccccgacgtcggccgggagggccgcggacgtcggtaacaaggaagtgagcacctcacccagaaccagcatgtcccccgccgccgtcgatcggagactcctccaggagtcgattggaccgcacgaccatcgatcgcgcaatgtccccgtattgtcaccttacgcatccggatccactgtcgatcgtcgatcctttcgcccggttcgtctacgctggaccgatgagccagcgcgcggacgtggtcgtcatcggcgccggggtctccggtctgaccagcgctctgtgcctcgccgaggcggggttcggggtgcgcgtgcacagcgccgatccgccggggcgcaccacgtcctgcgcggccggcgcgatctggggtccacacctggtggctcacgagcgggcgctcggctgggcgctgcgctccctggccgtgttccgcgacctggccgccgacccgcggaccggggtgcggctggtcgacggcgtcgaggccagccggggcgacctggtgacgccgcgccccggggccggcccggacgacgtgcgccgctgtgacccggcgacgctgccgcccggtttcaccaacggctggcgctaccgggtgccgctgatcgacatgagccgctacctcgaccacctgtgcgcccggctggccgggttcggcgtcgagatgacgatcggcgagccggtcaccgcggccgccctgccgggcttcgggccggtggtggtgaactgcaccggtctgggcgctcgcgacctcatccccggcgacccggtcgccccggtccgcggcgacctgctggtcaccgggaatcccggcatcaccgagttcttcgtcgagcacgacgacgacgcggacggcctgaccacctacgtgctgccgcagggcgaccgggtgatgctgggcggcagtcggcgcaccggggattactcgaccctgccggagccggcggcggcccgggcgatcctggaccgctgcacggcggccgagccgcgcctggccggcgtccaagtcctgcgtcatcacgtggggctgcgcccggtgcgcgaccgggtccggatcgggccggacgagacccacccgcacgtgatccacaactacgggcacggcggcggcggggtcaccctctcctggggctgtgctcaggaggtcgtcgcggtcactgcggccgcagcacgtaccatccgtccgcgctgaaaccggtcacccggtaaccggagccgagcgccttctggaagccggcgcgcacgccgatccgccaggtgcgggccaggtccgggtccttggtgcgcagcgcgtcgatgtcggccggggtgggcaccagcagcaccgcgccgtcctcgaccgggagcagggccaccgacgaccggccgaagtcccagaatccggggtcgaacggcgcgtcgacgggcgccagccccggcgccgggcggccggcgccgaactcccaggccaccaccaggcggtcggtgtcgtccccgtcgttcaccccgtcggtcaggctgccgtacaggttccgccggtacgactgcacggtgaccgggaacttggtgaggtagaagtacgcgttgcgccggaccagcggatcgaaggtccactggatgctggacagaccctcggcgaccgcccagtcccgctcatgctccatcaggcggtagcccagcccgaggttctgctggccggggagcaccccggcgatgtgcagatgcagatggtccgggccgcggaaggcgaccgccgcgccgaccatctcgccctgcacgaagatcccggccacgtagttgcgggccatcgccatggcacacagggtggacgcgttgatcaggtcgagcgcgttctccgcgccccaggcccggcacagcacgccgaccgcagcctcgaattcgtccatctggtcgagttcgcggatctccggacgcgggctggcagccatgacgaatcaccacagtcactcggacgacaacacagtggaaccgcgccagcctaatggcagccggagcgcgcggcgagagctgttcacacgaacgtaactgctggctatgtgcccagttcacgctgcgtacgaacccatctccccaacgtaactcaccaggggaaatagaggttacgaaagccgcggaccggacaattcacccagcgagctcggccgcccggtcccgggccgcctccagcgccgcgagcagtgccgcgcgcaccccgtgccgctccagctcgcgcagcgccgcggcggtcgtcccggccggcgaggtgaccgcctcgcgcagcagcaccggatgctcccccgagtcgcgcagcatcgccgcggaaccggccgcggtctgcacgatcagccgatgcgcgaccgcccggggcagcccgagcagcacgccggcgtcgatcatcgcctcggcgatcaggtagaagtacgccgggccggagccggacagcgcggtgaccgcgtcctgctggtactccgggacccggacggtcgcgccgagcggccggaacagctcctcggcggcgtccaggtgctcgccggtcgcatgcgcgcccgcggagagagccgtcatcgcctcgccgaccagggccggggtgttggtcatcacccggatcaccggggtgtcggcgggcagccggccggcgaagaagccggtggtcaggccggcgcacagggagaccacgagcgtgccgggggacagttccggcgcgatctcgtcgagcagcgggccggcgtcctgcggtttcacgccgaccaccacgatgccggcgcgcccggcggccgcggtgttgccggccagcgtcacgccgtacttgccggtcagctccgcgccgcgggccgggcgccgggcggtgaccacgatccggtcggccggccatccggaccggagcaggccggccagcacggcctcgcccatcttgccggtgccgagcaacgcgacggtctgctgagccacaacgatctccccagaggtggcacgatgccggggacggtgaccgcccccggcatcgatgatggatcagttgccgaagaagacctcggcctcttcgtaccgcgacagcgggacggtcttcagctcgccggtgccctcgatcagcgggacccggacgatgtcggtgccgcgcagcgccatcatcttgccgaagtcgccctcgtgcacggcgtcgatcgcctgcaggccgaagcgggtggagagcacccggtcgaacgcggtcggggtgccgccgcgctggatgtgaccgaggacgaccgtgcgggcctccttgccggtcttctcctccagctgctcggccagccactggccgatgccgccgaggcggacgtggccgaagctgtccagctcctggttgtgcagcaccatctggccgtcgagcggctgggcgccctcggcgacgaccacgatcggcgcgtactccacctggaagcgcttggtcacgtacgtcgcgacctgctcgacgtcgaacttgcgctccggcagcaggatgacgttggcgccaccggcgagaccggcgtgcagcgcgatccagccggcgtgccggcccatgacctcgacgaccagggtgcggtggtgcgactcggcggtggtgtgcagccggtcgatggcctccatcgcgatgttgaccgcggtgtcgaagccgaaggtgaagtcggtggcgttcaggtcgttgtcgatcgtcttcggcacgccgaccacgttgacgcccaggtcgtgcagcttggtcgcgacgccgagggtgtcctcgccgccgatcgcgaccagcgcgtcgacaccctgctcagccaggttggccttgatccgctcgacgccaccctcgatcttgaaggggttggtgcgcgaggagcccaggatggtgccgccgcgcggcaggatgccccggacctccgcgatgcccagcggcttcgtcagaccctccagcggacccttccagccgtcgcggaagccgacgaactcgtggccgtaagcggtgacgcccttgcgcaccacggcacggatgaccgcgttgagaccggggcagtcgccgccaccggtgagcacgccgatacgcatgtttctcctcgtccttccccttgcgggtagcgagatgcagatagcccgtgagaatccccgggagcgtcttcgtcggcagcgttgccggcccggggcgagccgcgaccaaactctagtctccgcccgccgggctgctgaacgcgccccttcccgatcagagcaacgacgcgaccctgctcggggcctcggcctgctcgccgagcagggtttaccggccggaaggatcaagttccgcgaacggatgtcgtgcgctgcggccgatgaccggccgccggcgcggccggaacgcatcgccctaccacccgtgggtggtcacggaaaatgcggaaggcccccggctgcggacagccgggggccttcttctcgcaccgggttcgtcagtgcgccatcgcgggcggggcgtccgggtcgacgtcgagcgggccggtccggaacagcaccagcgcgacgaccgcggccaggacgaagaagccggccgaccaccagaacaccgtgtggtagctctcgatctgggcctgcagttgcagcagctggctgggctgcttgcccttcgcatagtcggtggcggcggtggccgcgaacgagctgagcagcgcggtgccgatcgagccgccgatctgctgcaccgtgttgatcatcgcggaggcgacgccggcgtcgcggtgctcgacgccggaggtggcggcgttctgcgtgggtgcgaagaccaggccgaggccgagaccgatgacgatcaggccgggcaggaccccggaagcgtacgtggagtccaggtccagtcgggtgagcaggagcaggccgccggccgcgaccagggcgccgagcgggaccagcgggcgcgggccgaccttcggggccaggatggagccggccgtggtcgcggtcagcatcaccgagccgagcatcggcaggaacgccaggccggtcttcaccggggtgaagtgcagcacgacggccaggtaataggtgaggaacaggaagatgccgaacatgccggcgccggcgatcgcgatcgaggcgtacgagccgccgcggttgcggtccaggacgacgcgcagcggcagcagcgggtgctcgacgcggcgctcgatcagcacgaagaggatcagggcgacgacgccgacgatgatcgggccgagggtcccgcgggccgtccagccgtcggtctccgccttgcccagaccgtagacgaggccgaccaggccgaccacggcggcgatggtgccgggcacgtcgatccggccgtgcgcgccggacggctcgtccttgagcttcagcatcgcgccggccaccgcgagggcggcgatcaccaggttgacgtagaggcaccagcgccaggacacgtactcggtgagcacgccgccgagcagcaggccgatgccgccgccggcgccggagatggcgccgaagatgccgaacgccttgccgcgctcggccggctcggtgaacgtggtggacagcagcgagagcgcggccggggccagcgccgcgccgaacgcgccctgcagcgcgcgggccacgatcagcatctccaggccgttggcggcgccgccgagagcggacgccgaggcgaagccgatcaggccgatgaggaacatccgcttgcggccgaagaagtcggagagccggccgccgagcagcagcaggctgccgaaggcgagcgcgtatccggtgaccacccactggcggtcggcgttcgagaagtgcagcgaggcctgcgcggtgggcagcgcgatgttcacgatcgtggcgtcgagcaccaccatcagctgcgccagggagagcaccaccagcgcccaccagcggccggtgtcggccgacgcctcacgtccggctttccggggtcgatcaagaagggtgctcatcacggcctttcaaaaagttgaggtacatcctccacttcggcaggctagcaccggaagttgaggagtcgcctccggatagttgtacccttcaccacatgaccgagacggacgtggcacgcggatgaccgagacggacgcggaccgcggatgaccgagaccacccgcccgctgcgccgcgacgcccagcgcaaccgggagcgcatcctgcacgccgcgcacgacgtgttcgcggcccgcggtttcgccgcgaccctggacgacgtcgcgcatcacgcgggcgtcggggtgggcacggtctaccgacgcttcccgaccaaggaggcgctgatcgaggcgatcttcgcggagcggctggaggatctggtctcgctcgccgaggacgcgctggcgctgcccgcgggctgggacgggctgaccatgatgctgcgccgctcgatcgagatgcacgcggtcgaccgcgggctgcgcgacgcggcgctctgcgtgggcgtcggcaagcagcacttcgccgaggtcgccgaccacctggtgccgctggtccaggagctgatcgaccgggcgcacgcggagggctcactgcggcccgacgtgggactgcacgacctgccggtgatcatggccacggtgaccgaattggcccagcacagcagcgccggccgaccagccgtctaccgccgcttcctggagctgatcatcgacggcctccgcgcccggccggacaacggcgacctcggcccggcgatgacccaggccgacgtcgaggccgtcgtcgacgactgcgtgccctcgatcaagaggacctaggtcgccgcgggcccacatcgccacgggcccacgtcgccacgggcccacgtcgccacgaggcgggtcgccacgggccccggtagaagctaggaaccggaccccatggcctgccagcgcgccaggttgtgccgcgcgtcgaccagtgcgtcatgccgcccggccatctccggcagcgccggccgtccccggtcgtcccaccgctggcgcaggtccttggtgaaccgcgggatctcccgcggcagggccggcatcgccccccacagctgggccagcgccacgtggtcgtacgccgcgtaccacgcccagagctccatctgctcgttacgcccgcgcagcggctccatcaggaactcgtagagctcctcacggatccgctcccggctgcgccacgccttgtcggccggcgacggcagcttgtccagcacgttgcggcgcacccagggcacggcgcgactgtcgtcgaactcggtgctgaccgcgtagaactcgcggccgaactcgtcgacgacaccgatcgagaccaggtcgacgagccggccgtcctcgatgaattcacagtcgtagaaatagcggtagaccatcgcggtacatcctcgcccatcgtcatccgggcatggacgtcagggcctcccgcgccgccgccagcccggtggggcagccccggcgggcggaccgctcggccagcaccgcccagcgcagccgcagcagcaccggcagggcggcttccagctcgtcggcggccaccggcccggcgcagcggtagccgtcgagcagttcggcggcccggtccggcccgccggcgtagatcaccgcggcggccacgtcgtagacgagcggcccggtgccgctggtaccgcagtgcagcagcccggtgcggccggtgtcgacgtccaggacgaacgcctcgggggccgggtcaccgtgcagcaccccgtaggtgagccggtcggtcacggtgagccgggtggcggcggtgaccgcggcggcgacggcgggccgcagccacggttcggcgtccaggtgcgccgcgtccgcttcgaccggctgccagggccgcagcccggggtgcacgaagccgtccagggcccggtggaccgcgccgagccgttcgccccaccactgctggtcgatcgggtcggcgccgtcgaggtggcgcccgggtggccggcgcagcaccgcgagggccccgagcggggtttcggcggtgagctgcccggccagggtccggaccggttcgccggcgctgatccgcacgccgcgcaggtgcacggcggcggccagaccggcttcggcgggcagtcgcgcggcggtctccacgagacgggccacgtagcgctcacgtcccgcggtgacctcccagtcgcgcgacatcacggccctcggcagcgcggtgatcccgctgggattcaggtgccactggtcgcgcagagcgattcgcagaatctcatcttccggcaccgcgggattatcacggcacaccacccaaatgcgacggacagccagggtgacaatcacagaaggcgatgaggtgtttacagaaagcgactgagacgacatgatcgtacgtggcgagcgtcgatgtccggtcgggaaatggcgctcggagcgcgccgtgtgctaagagtgatcgttcgcgtcagggggccggcaccagccgggtggacgcggtcaccctggggggagggataacgccgtggaccatcgcatgccggattccggtgacgcgctcaccggcgtcgaaatgttcgccgggctcgagccggatgtccgacagcgggtgatcgccgcggcggttccgcgccattaccgcaaggggcagatcctcttcgtcgagcacgatccgggcgactcgctgatcatcatgaaacggggcgcggtggcggtcttccgcaccgcgccgaccggtgagcgcgcggtgctcaccgtggtccgcccgccggacgtgctgggcgaggtgtcgctgctggacgccttgacccgcagcgcatcggccgaggcgatcgaggactcgcaggcgctgtcgctgtcccgggccgccttcatggacctggtccactcgaacccgcggatcctcgatgcggtgatgcgatcggtcggggggctgatccgtcgtctcaccgagcagaacgccgaccacgtcttcctggacctgcccggtcgggtggccaagacgctggtccggctctccggggagagtcaggcgccgatgatcaccatcgagctgaaccagagccagctggccgagatggccggcgggtcccggcagagtgtgaaccaggcgatcggctcgttcgccaaccgcggctggctgcgcaccgagggccgccggatcgtggtcaccgacgtgcaggccctgaaacgccgggcgggcatgaactgaggcttccggtccgctgcggtccaggccgatcgatcggcggtacgcggtgagccccgccccaccatggggggtggctcacccgtaccgccgaatcgacggtcgccagaccggccggaccggaagtgatcaggcgggttgcgggtctttcagcttcgcggcatagacgtcgacgtactcccggccggagagcgccatcagctcgaacatgatctcgtcggtgatcgcgcgctcgacgaaccggtccccgcgcgagtcggcgtaacgggagaagtcgagcggtgcgccgatccgcatccggacccgcttgaccgtcgggaccagcgtgccggtcggctggatctcgtcggtgttgagcagcgccaccgggacgaccggggcgccgctctccagcgccagacgggccacgccggtcttgccgcggtacagccggccgtcgggcgaccgggtgccctccgggtagatgccggcgatgttgccctcgcggagcaccctcaggagggtgtcgagcgccgcctgggcagcctcgccgcccgaacggtccaccgggatggtcccggcgccgacgaagaacatccgggagagccagcccttgatccccttgccggtgaagtattcagctttcgcgacgaaggtcactttccgcttcatcaccaacggggtgaagatcgagtcggagaacgagaggtggttgcacgccaggatcaccgggccggaacgcggcacgttcgccaggccctcgacgtgggggcggaagacgagcttcagcacgggtccgaggaccaccaacttgagcagccagtagaacactgccgtcctttcagcggatgccgccggcgtcccggggcgcaagaagggtacgaagcgggggcggcgcgccacaacgcactcccgcaacaggcgcctgccgtgtcaccattcaaggcacggtcgggcaaggggggtgcatcggtgacagcgggcggcgcccgtcgcgggcggcgggacaacggactcgacgcgaccgactacgcggtcgcgggcgacgtcgacccacgcgtaggggaacatctgctcgacgtgctcgccggtgacggcatcgcggcatatctgcaacccaccgcggatctcaacccgatcctgcgggccaccacgctgcccgcccggccgatcgaccggctctacgtggaccgcctccacctggacaccgcgcgggagcacctgcagcaggtgaccgggggcgtgccgcccaccccgccggccgagccggcgccggcaccccggccgcagtccgaggtcgacgccgagtgggaccggatcatcgccgggttccacaccacggtcgacccggccgcggcgccgtggccggagtccgagggcaccacctccgacgccgaccgcaaggaccggagccggcccgtcggtgaggacggccgcccggtcaaccggcggcgcaccgatcccccaccgccggagccggtggtctatccggtgatcgacccgttcggcttccccgacgtcgccgacgaggacgagcggtatgtgccgccgccgcccccgccgctgccgcacatctcgaaatacacggtcgccggcacgctcggcgtgatcctcggcttcgtgctgttcctgttcccgacgctgatcccggtcgaccgcaacttcgtgatgttcttcggcttcgccgggatcgtcggcggggcgatcaccctggtgtggcggctgcgctccggtgacgacgacgacgaattcgacgacggcgccgtggtctgaccgcgctgacccaaatcagtcaatcgaccaacttcggtgctctgccggtaacctacggtgatgcgccagagttcgctcgtcgtcgtcgcacaccgtctgcccctcaacgacagcgccgccgccgacggcgcctgcgagtggcggcagagcccgggcggtctggccagcgccctgcacgccatcctgcagcagaccccggccacctgggtcggctggagcggtgtggtcggcccggccccccggctgccggacatcggcagcctgcgcctgcgaccggtcgcgctgagcgatgacgaactgcgcggccactacgaagggttcgcgaacgcgacgctctggccgctgtaccacgacgccgtccagcagccggtcttccagcgcgagtggtgggagacctaccgcgcggtcaaccagcggttcgccgaagccgccgccgaggtggccggccgcaacgcggcggtctgggtgcaggactaccacctgcaactcgtcccgcggatgctccgcgagctgcggcccgacctgctgatcggcttcttcatgcacgtgccgttcccgccgccggaactgttcatgcagctgccccgccgggtcgagctggtgcacgggctgctcggcgccgacctggtcggcttccagcgggaacaggccgcgcacaacctcgcccagctggccaagaagctgctcggggcggacgccaccgacgacgcgatcacggtcggcgggcggaccgtgcgcaccggggcgttcccggtctccatcgacgtggccgagatgagcgcgctggccgcccggcccgatgtggcggcccacgcccggcagctgcggcacgacctcggtgagcagaaacgggtgctgctcagcgtcgaccggctggactacaccaaaggcatcgagcaccggctcaccgcgtaccgggaactgctgcgcgacgggtacgtcaaggtccgcgacacggtactggtgcaggtcgcggtgcccagccgggaacgcgtcgacagctatcgcgacctgcgggaccgggtcgagggtgaggtcggccggatcaacggggagtacgggcgggtcggcgaacccgccatccactacctcaaccagccgttcgaccgctgggaactggccgcgctgtaccggaccgcggacgtgatggtggtgaccccgctgcgggacgggatgaacctggtggccaaggagttcgtggcggcccgcgcggacggcaccggagcactggtgctcagcgagttcgccggggcggccgccgagctcgacgaggcgttcctggtcaacccgcacgacctggacgggttgaagcagacgctgctgcgggcgctggaggcggacccggccgacctggccgcccggatgaccgcgatgcgccggcacctggccgaacacgacatccacgcctgggcccgcgcctacctcaccgccctcgaccacaccggccgcctcgcccagcggctaggcgcgcggtagctgcttgtccagccagtccaggacggcgtcgatcggctccgcccagctcggctccagcatcagctcgtggcccatgccgggaaacatcagcggggcgccggcataggccgcggccgcccggtccagcgccttgcggcccaccacccggtcgtccgggctgcccgccaccagcaccggcggcgcaccgaccggacgcggcggcctgacccgacgcagcagctcgacccgcggccgcggccggatccggcccaggtacgcggacgcctgctcggccggcactccggcgctgaacagctgccgggcggacagccgaagccggccgccgaacagggcgggcagcgtcccggccggattggcccgcaccgccgaccccagtgccgaccagccgtccagcacaggggcggccagcaccgcggcgcgcgccggatagcgacccagggcacgggccaccaccagggcgccgacgccgtggccgaccagcaccgcctgccgcggcaacccggccgcggtctgcaccacgtcgtgcaccagggcgcgcagatccccgccggggcgcgggctgaccgcgtacgccgggaaaccgcggccggcggtgtgcggcagccaatgctcggcgaacgcccagccgccgtgccccagcccgggcacgaacaccaccggcgggcggccgcgatcctcgtccggcagccgggacacgatctcccgctgggccggcggcaccggatcggtccaatcgtcgaaccggagcagatcaaaaccagtcacgcggccggctccatctcagtgagcagactctgcaggcaacggagataggcgacgtggtccacctcgaaccagtgccgttcggtgtccaccacccggcgccgtgaccaggccgacagcggcttcgccgactccctctgctggaccgcggcggcccgcgccggatcggtcagccgcagccgcagccaccgggccgccgccacgctctgccagtgcgccagcggcagcaacccggaatccggctgcagcaggccgatcaccacgagcgtcggattcttccgggcgaacgtgtgcaggtgcaggtcggggcggccgtgctcgtcggcgtcgagcaggcccggctccaggaactcgaaccgcggacggtacccggtcgcggtgatcaccaggtcgggctcgatgcgctgcccgccggccagctccaccgcggcgtcgtcgaacgccgtcacgtccggcaccggggtgatccgcccgtggccgagaagatacggcagctggctgttgacgaccggatgggtctcgtacggctggtggtccggcgccggcagcccgaaccgggtcaggtcgccggtggtcagccggaccgtgcggcgatagagccactgccgcaggcgcagcggcagccgccacctcagcagccgatcgttgacctggtcggcggggcgacccagcacgtacttcggcgcgtaccagtacccccggcgggtcgaatgccacacctgggcggcctgctgcgcggcctccaccgcgatgtcgcagccggtgttgccgccgccgatcaccagcaccttgcgcccacgcagcacagccggatccttgtacgccccggcgtgcatcacccggccccggaactcgccgggaatctccggcttccgcggatcccagttgtgcccgttcgccacgatcagcgcggcgtaccgcgaggtgcgggacgtgccaccgccggtcgaccgggtggtcacctcccagccgccgtccccggtcggcgccgccgacaccacctccatgccgaaccagatgtgctcacccagcccgaaatgcgcggcataccgctccaggtaggtcagcacctggctgtggtgcgggtagtccggccaggtgtccggcatcgggaaatcggggaactcggtgagcggccgcgacgagatcagatgggtgccggccgacaccgggctgcggtcgtgccgccagttccaggcgccacccaccccggtctcccgctcgtagcagtcgacctggaagcccagctcacgcagattcttcacggcggtcaggccgctggggccggcgccgacgacgcagacggcgtcacggcggtcaccgatgtccggggagtcgtgcacccggcgatcctgccagacggggccccgggccggaagctcagtccggcggcagcagaaggtccgcgagaatcggcagatgatcactggcgacgcgcgcccggtcggtcgcgatgatctcgtaccgctcgatggtgacgtccggggtgacgaacagggcgtcgatccgccggctcggcgccgacgccggataggtcggctcgtcgtcccgggtggtcagcagcccgtcctcgacggtgcgccaggcgccgccgcccgggccctcgttcagatcggccgccacgatcaccggaccggtcagcgcggacagctcgtccttccagagcgcggcctgggccgggcgctccgccgggtcggtggccaggtgcgaaccggacacggtgaaggacgccccgcgcacccggccccgggcgaagaacgcgccgcgcagatgccggcccggggtcagcggatagcgcaggttccacgtctggccgaccgccacccgcaggtcgaccagcagcaggttgcccagtgcgggcagcccgccggcggcgaccaccaggccgcactcgccggccagcgtcgccgacttctcccgccagcggaaccggcgcggtgcctcctgcacgatcaggacgtccggggccagctcgcggaccaggccggtcagcgccgcccggtcgtcggacaacccgtgcacgttccagctgagcacgcgcaacggaaccccggacatccccgccccctcgcctcggtggctaacgccgggccaggtcggccgcgcccacgacgccggccacattacccatctgggcggcgcgcacctcggccaccgggaaccggtcccgctgggcgagctgatcgcggtaggtccgctccgccgggcccatcagcagcgggccggcgtcgatcaccccaccgccgatcaccaggatctgcgggtccaggctctgcgccaggtcggccagggccaccccgagccagtacccgatctgcgcgaacgcgtccatcgccacaccgtcaccggcccgggccgcctcggtgatctgccgcccggtgatcgccagcgcgtccccaccggccagctccagcagcttcgccgcccgctccggctcctgccgggcgccggcgcgggcgaaccggaccagggcgttgccgctcgcatactgctccaggcagccgagccggccgcagccgcacggatgcccgtccggcaccgactggaggtgaccgagctcaccggcgatcccgttggcgccgtgccacagcttgccgttcagcacgatgccgccaccgatcccggtgcccaccgtgatcatcaccatcgagtcgtcggcgtgcttggccaccccgaaccggaactcggcccaggccgcgacgttcgcgtcgttctccagcacggtcggcaggcccacggccttcgacacgtagtcgcgcagcggctcgtcccgccaggccaggttcggcgcgaacagcaccgtcgacccggccgcgtcgatccaggccgcggcgccgatcccgatcgcggtcgcggccgggtactgcgccgccagctcggcggccacctcgacgatcgtgtcccgggtgccggccgggtcgtcggccggtgtcggccgccggttcgaagcgagcacgttgccgtgctcgtcgaccacaccaccggcgaccttggtgccgccgacgtcgattccgatggtcagcgtcacgctgcccgtcccctcttcacaccgcgtcgccgtcccgggcgccatcgcccgccccggccccgcgatcctcgggcgcttccgcgccccgcacatgatccacgctacgggtcgggcccgcgccaccttcggcggcctccgccgtgcccacggaccggatgtccgcagccgcccgcttccgtccggccgcggcctccccgtccccactccggcccgccccggcggtcccgccggcatccccggccgcgcgcttgcgcggagcggcccgcttccgggcagccttcggcgcctcaccggccaccgaacccgcatcccccaacgacccgccctgctcccgcgacccgccctgctccggcacggccgctacttctccggccttccggccagatcgctcggccgcgccggcacctagctagctagggccaccgcctgctccgccgcccgagcccgggcgcgcgcctcctcggcctccctggcgctgtccgccgtcgcggcggcccacgggtcggcctcccgatccgaaccggaagcatcggccccggcgaccgcacccgtccaggaagccgcgcgcaccgtggtcgccggccggggcgagccggcctgatccgccgccgacggataaccggcctgacccgtcaccggtggagagccggccggacgtgccgcctgcgcgacgccagcctgacctgccacccgacccgcagtctgcccagactcgtcccggtccaccggccgggccgggacgcccgccgcggacactgatcctgtcgtttcggcgagatcatgcggattggtcggtctggccggatctgccgcccgggtcgccgccgaccacgcctgatcggagctcggcgcacgccgcccttcacccgttgcctgccgccccgcgcccggcgcctgccattccccgctcggcgcctgccgccccgggctcggcgcctgccgttccccgctcgttggctgccgccccgcaccaggcgcctgccgttccccgcccggcgcctgccgccccgcgcccccgccgggagatttccgggtcggccgcgaccgctcccccagcacggcgccggccagtgacgacagaccgcgcagcacgcccgccgccccgccggccaggtccccggccccggtcacgaccttgaagacggtttccgggctggggttgcgcgccgccgcgatcgcctgacagaccgggcacacgcagcattccgggctgccggtcgcccagcgtccgccgggcccgggcgtgccgggttgacccgctccgccgcgggccacgtcgttgagcatcccgaagaagccgtcgacggtgttgcccaccagcttcgccgtcccggagaccgcggcgcccgcgaccttccccgcgtcggcggacgaggcggccgacgccgcggctgacaccccggccgtcgcggccctggcgatgatcgccgccaccagtcgctccgcctcgtcacgtgcggacccggccatcgctccccctcaccacccgcggccccgccgcggaagatcaccgcacccgcgaccccggccgcgagcaagatcaccgcactcacggcccggccgcgagcaagaacccccgcggcccggccgcgagcacacccacactcacggttccagccgcgagcaacatccgcacccacggccccgccacgagcggaaacccgcaacccggccgatcaaacccggaccgagccaccaacgaaccgacccgacaccggaccgggggccccgagccgatcccaccccgaactgacccgaacccggaccgcccgcccggaccgcccgaatccggaccgcccgaccgccaggccgaccggcgatccccgcgatcaggccgcgggcaggctctcgacccgccgcttgagctccttcaacgccgtatccatgatcatcttctctgccttgcggcggaacatccccagcatgccgatcgccagctcgacggcgagcgtgtaggtcaccgtcgtcccgccatccgcggtggggaccaattcgtacgccccctcctgggacttctgggtcttggagggcgcgacgagatgccactcgatccgggagaggtcgtcggcgtacgcgtactccaacgtgtactcgtcggccatcaccccggcgtcgatccggaaggcgacctgtgcggcatatccgtcctcgtactcctcgacgacggtggcctgtttgatcgcctcggcccactccgggtaggccgggaagtcacagatcacctcggccacccgggccgggggcgcagcgacctggatcgactgggtcgaggtgtccgccatgcacgggaggctacccgctgggtacgacaaagcgtgccaccgccccgtcgccgaacgggccgtttcccgcccgggccgctaccatccgtgacgtgccagcccaagccagcggttccacgcgcatccgcccgctcgaagccgccgcgcgtgtgatcatgctcgcgctggtcgccgtgctctccctgatcgccagcggtgacccgcgccagctgggctgggtcgccctgctggcggtcgccgcggtgcccgccttcgtggcccgccggcatccggtgctggccccggccggccggttcgccgaggtgatcgtgaccggtctcgcggccggtttcatcgccaaggcgtcgaccggggcggtgcagggtttcggcgccgaggcgatcctgccgtacctcgcggtgccgctgctgaccgcggcgctgcgccgcaagccgaccgagggtgccgcgctgctcggcgtggccgcggtggcgatggtggccggcggcgcgctggccggaccgaagacggtgctggccggcaccggctatctggcggccggcgggcagtggctggtgctgggcgcgatcgtgacgttcgcggccgaggcgatgcgccagttcctgcagccggccgaggcgaccccgcagccgtacgcggaggccacccgcctgctcacccagctgcgcagcgtcgcccgttcgctgcccggcgcgaccctggacccgggcggcatctccgagcacctgctggaggagttgcgcgcggtcaccccggggcaccgggccgcggtgctctcggccagcggcggcggccggctggtggtgctggcgcagaccggggcggagcgggtcgactgggagaccacgctcgacgccgactcggcgatcgccgacgcctgggccacccagcagccgcacgtggcgagccggtcgcaggcccgcacgcaccggggcggcgaggtgtcctcgctggtcgtcccgctggtcgccggggtccggacgatcggcctggtgattctggagacggacgccgcgggggcgtacccgtcgccggtggtgcagagcgtgaccgaggtgaccgagccggccgcgctgcggctggaggccgccctgctcttcgacgacgtccggtcgctggccaccaacgaggagcggcagcggctggcccgggagatccacgacggggtcgcccaggaattggtgatggtcggctacggcatcgacaacgcgcaggccaccctgccggagggggccgaggagacggcggaggagctgcgcgcgctgcgcggcgaggtgacccgggtgatcaccgagttgcggctgagcctgttcgagcttcggtcggaggtcgaccgcaacggcggtctggccgccgcgatcgcggagtacgcgcggaccctgggcaccagcgccggcctgcgggtgcacttcaccttcgacgagtcgaccgcgcgtctgcccgcggcgacggaggcggaactgctgcgcatcgcccaggaggcgatcacgaacgcgcgcaagcacgccggcgccgcgaacctgtgggtcacgtgcacggtggatccgccgtacgcggaaatcgaggtttctgacgacggcaagggtttcgccgacaatcggcccgatggccggtacggtctcaccatcatggccgagcgggccgaacgcatccggggtcgtctcaagatcactccacgacaccccagcgggacaaccgtcgccgtagtgctcggaaccccgcctcggcgcgatagcgtgcgggatagcgtttccgctccagaaggggagtaacccgagcatgtcgaccagtcctgcgccgacgacgcgcaccaaggtcctccttgtcgacgatcacgacttgatccgtaaggggctgcgacacgcattcgagcgcgaccggcagttcgaggtcgtcggcgaggcggcgacggccgcggaggcggtgcgccaggccggtgcgctgcagccggacgtcgtgatcatggacctccggctgccggacggcagcggcctggaggccacccgcgccctgcgcaagaacaacgccaacatgggcatcgtggtgctcaccatgtatgcgggcgacgaccagctgttcggcgcgctcgaggccggggccagcgccttcgtgccgaagacggccccggccgacgaggtggtggcggcggcccggcatgccgcgtcggcgcccagcgcgttcaccgcggccgacctggccgaggcgatgaaacgccggctcgccccgtccggtccgcagctgtcgccgcgcgagggtcaggtgctgcggctgctggccgacggcatgagtgtggccgggatcgccaagcagctgttcgtctcggagtcgacggcgaagacgcacatctcgaagctgtacgagaagctgggtgcggcgaaccgggcgcaggcgctcatgacagcgctgcggctgggactcctggaagccccggacgccccgaagttctagacattgccgacaccttcggcgtttctgcccgtcagcctgcgaatccccagataggcctcgcagcccaggcagagcccgaaagccgcgttcaggaacgccgcgagcagcccgaaggccgcggcgacaagaccgactgtctccgcacccgcgaggtaacccgccgcggagacgctcaaaaaggcgaatccgactagctgcgcaaagcgcacgggggcagcgggttcggacggctgcggtgtcaccaggagccggaagatccaggggtagggaccccatttcggccggtacgcggtgaccgcgaagaccgcggcctgagcgagcgccagccagccggagccggtgatcagcacgagggcgatgacgatgctggtgatggccgcggcgaagcgctggccacgcgggtcgaggagcatcgacccattattcccccagggaatgtaggactttccgcagtaggccgttgagctgctccagctcctccagggagagcacccggagcgcctcctggtcgcgcgccatacccgcgaagatgtccgcactccaccggtcccggccggccggcgtcggccggatcagcacccgccgccggtcctgcgcatcgacggtccgggtcaccaggccggccgcctccagccggtcgagccggctggtcatcgcggcccgggtcacgttcgccgcttcggccagttgcgccggggtcgcctcggtcggccacggctggatcatcaacacgtgcagggtcttgtagtcctgcagcgtgaagtcgtcgccgttgcgggcgaacgccgccgcgtcggcccgctcgatccggcgcaggatgtgcttcatccgcaccagggcaccctccacctcgggcgcgaactgcggctcgtccttccagaacgccgcccaccgggccacgtgctgatccactccgtcttccatccggccatctttgcacgccatctgattattagttgcctgatagttagacggtaaattattttgggcccatgacacgcgacttccggcttctcgctgccggccagaccctgtcctggctgggcaccggcttccagaccgtggccctcgcggtcgcggtcttcgcccacggtggcagcgtccgcgacctcggcctggtgatggccgcctcggtgctcaccatgctggccggcacactgttcggcggcgtctgggcggaccggctgcagccccggcacgtcatggtcgtctccgacgtcatccggatgctgtccaccgccggcctggcgctgatgttccgcggcggcggctaccacctgggcgccctctgcgcgctcacggtggtctcggccggtgccggcgccttcttcaccccggcgatgagcgcgctcaaaccgctgctggtcccggccgtcgatctgcagcgggccaacgccacactgagcatgctgcagaccggctgcggggtcgccggcccggtgctcggcggcctcgtcgtcgccgccgtcggcgctccggccggcttcgccgtcaactcggtcagcttcctggcctccctggtcaccgccgcattgattcgcgtacgcgtggagcgtggcccgcatgagccgatgctgcgtgagctgggcgccggatggcaggcgatccgcagccgggactggctgctgggtgggatgctcagcgccaccgtctaccacgtggcgaacgggatcatcctggtccttgtgccgttgatcgcatggcagcggctcggcggcgcgcacgcgatcggctggatctccggcgccgagggactgggcggcctgctcggctcggcgctcgccctgcgcgtgcggccccgtcgcctgctccgggccgggtggctcacgctgatgctgatgccgttctgggcgttgtcgtacgtctggcccggcaggctcaccgcggtgctggccggcgcgatcgtcggatacggcggcctgatgttcttcgcggtggcctgggagaccgcgatccaggaccgggtgccacggaccatgctgggccgggtggcgtcctgggactacctgacgtcgttcctggcgatgccggtgggcaacgcgctggccggcccgctgaccgcccggttcggcgtcgatcgggtgctggtggcctgcgcgttcgtgctgttcgccgcggccgcgtccccgctactgatccgcggctcccgcgatctgacccggtccgccgagccggccggagtcgccgcgcacgcctgactcggccagggccgcgatcagctgcggcttggccggcaccccggtggcacgtctggtcacccggccggcgccgtccacgatcagcagcgtcggggtgcgccagatgtccagctcgcggacctcgtcgaggtggctctccgcgtccacctcgacgtgccgcacctcggggagcagcgccaccacctcggcgctgacccggcgcacggcccggcagggcgcgcagaacgcggtggagaactgcagcagcgtgacccggccgggctccaccccgagccggacgagcagggcgcgatccaccgtgtccacggccccagtctgccgcacgccgccatccgtccggcgccgccaccacccgacgccggccccggccacgagcaccacgccgaccgccgccaaacccaccggatccatgggacaactgtgacacctgatcaggcggattgataggcgctggcctgcaacgtgaacagctgcgcgtacaacccgccggccgccatcagctcgtcgtgaccgccctgctcgacgaccgcgccgtgatccagcacatagatccggtcggcctcgcggacactggccatccggtgcgtgatcagcaccacggtccggccggcggccagcccgcgcagccggccgtacacctcgtgctcggcccgcgcgtccaggttcgcggtcggctcgtcacagatcagcagcggcgcgtcccggtggaacgcccggctcaccgcgagccgctgccactgcccgccggacaggtcggcgccgtcggtgaaatgccgggacagcagcgtctcgtacccccggggaagttccgtcacgaacccgtgggcgtcaccggcccgggccgattcgcgcacctcggccagcgacgccggccggtcgtgccgcccgatcgcgatgttggcccgcgccgacagcggccaccgggtcggctcctgcatcaccaccgccacccgctcgcgcaccgactccggccggaaccgggtcacgtccaccccgtcccagctgaccgtgccctgctgcggccggtacagcccggccagcaccgcggccagcgtcgacttcccggagccgttctccccgaccagcgcgatgatctcgccgcggcgcagcgtcatgctcaccccgtccaccgcggcccgctccgcatccggataccggaacgtcacgccgtccacccggatctcgccgaacgtcgccggcgcgggcacctcggacgctggctcggcccgcgcctcggacagctcgcagaacccctggaaatcggcgaagtacaacccgtactcgtacacccggttcgccgagaaggccagttcgcgcagtttggaaataccgatattgatggcgtacgcggcggcgcccccggcggcgagctccatccgccccgtccacaacagccagcacagcgtcacatacgccagcccggtgagcagcccgctcagtgcctgcccggccagattcgtccggacctgccgggtcaccatacggatctcctccaccgtggagatccgcagcaggcgggccacctcggcgagcaggaaccggcgtaccgtgaaggcccgcagttcggcggccggttcccgcgccgccaacaggtaggcgagcatccgctggcgccgccacacggcgatcaaccgcagccggctgcgatacccggcacgcgccgcccgcaccgccgcccagccggtcggaaccaccgccaggatcagcagcggcagcagcgccggatgcagcacggccagcaccccggccgccgccaccagcccgatcacgtgggtcagcacctcgatgccgaagtccaccacctgctgtgccgcgtcgatcccccggtcgcgggcccgttccatggcgtcccgccagtccggatcgtcgaaggtcgccagatccacccgcgtggtcagatcgagcagccggttctcggccgcctcgtacaccgccggcgacagccgcccgtgcgccgccgtcgccgcactggccagcaagccccgcaccgccagcgccgccaccaggaacagcagcgacggcaccgccgcacgcacccgctccggcgtcggcccggcctgcagcagcccgtcgaacacccccaccacgctgatcagccccagcgcccccgccaccccggccgccacctgcagaacgagaaccgcgacggtggtaccgggactggcccgccagcccaacagccaagcctgcctgagcagcctcggcagccgccgcaacatctgcaggaaggtggtgtcggcggcctcctgggtgctggtcagccagtagggcagctccagctcgccctctcccccagcctccagcaccaccggctggtcgtcctccgtcgtcggtggggaggcgccggcggcgggcacggccgcaggcggcgggtggtcggcggtggcgggtcgggcggtgtcggcgtccggcatcggcggcctccggtcgggatccctccgttccgttcctacgcccccgccccgccccatgtccacgctcattcacgccgggatccccccggcgtggccacccaggacccgtgacctgcgggacgccgctgatcgggatccttaccggcctgatcggccacccacccgatgccgacgatcggcacccggccctacccggtcggtagtcggccggacggccgcgatcggtcggtagtcggctggacggccgcgatcggtatcctcccgggccatgacggagaagatctttccagccgaggccgacgaggcacgcttctggagcctgatcgagtcggcctggaccgccctcggcgacgaacccgcccgcctgcgccacgagctgctgaccggggcgcccggcacggatccatatgcgatcgacgcctggctggaccgcttcgtggagcagctcaccgccctctctgccgatctctcctcggccgaactgaccgctttggaccgggtgctggaacgcaaacttcacgacctcgaccgtgcggacatccacgaggtcaccgacggttccgacgacggcttcctctacgcgcgtggacacatcgtcgctctgggccgggcctactacgacgcggtcagcgccgacccgcagaaggccgtcgtggacgccgactgcgaagccatgtgctatctcttcgcgaacctccaccaggaacgcttcggtagctggccggaaaccggttccggcatcagccgcgaaagcggctccaactccagcggctggagcagctgacagccgctcacgaccaacccgctggaaccaccgaccgctgtaccggcaatcgctggacgcggacaaaccgctggccctacccgccccgcgggcgtggtcagcccgacccgcgcaacgcggacgcggacgcggacgcgaccagcacggctgaatcgatcgcggcggtcatctggtccggttgaagcgggccggaccaggcaggcgggccgggccgggcagggaagccgggtcgggcaggcgggcagacacaggcgaccgggtcaggcaggcgggcagacacaggcgaccgggtcaggccggcgggctcaggcaggcgggcggacgcaggcggccgggtcaggcgggtggggtgagcaggttggtgaggcgggcggcctgggtttcccagcgccactccttctcgacccaggctcggccggcctgacccatggtgcgggcctgatccgggtcggacagcagggtggtgaggcggtcggtgaggccggccaggtcggtgccgccgacgacatagccggtttcgccgtcgcggaccgcgtcgggggcgccaccggagtcaccgccgacgaccgggaggccggtggcggaggcttccaggtagacgatgccgaggccttcgacgtccaggccggcggcgcgggtgcggcacggcatcgcgtagacgtcgccggccgcgtagtgctcggggagttccgcccacgggaccgagccggtgaagatcacgtcggactcgacgccgtgatcgcgggccagggtggccagggtcttgcggtacggaccgccgctgaccagcagcagcgccgcgccggggacgcggcggcgaagctccgggagggcacggatcagcatgtcctgccccttgcgcgggaccagccgggacacgcagaccaccaccgggcggtcggcgaggccgtgccgtttgcggaccgcggagccgtcgacgccgggatggaacgtgtcgacgtcgacgccgggggcgagtcgtcgcaggtcggtcagcccgtgcagcgccctgtcgaggcggacccgctggtactcccccaggtaggtgatgacgtcactgccgcgggcgatgcggcgcagcagcgaacgggcgccgggcagggcggcccagccgatctcgtggccgtgggtgatgccgaccgcgcgggtgatcccggcggtgcggcgcaggccgtgggcgagcagcccgagcggggcggccgcgccgaacaggacgctgtcgcacccgtgtgcgcgggcgagttcgccggcccgtctggcgaccgccggggtgggtaggagcatcccggtgtcctcccggaccacctcgaacggctgctcggcgtcgaacgcggccgcccctttccaagtggacgagtagacgatcaccgagccggccggctggcgcaccgcgaggttgtgcacgaactgttgaatgccgccgggccgcggcggaaagtcgttggtgaccagcagcgtgcgcgccatcagcggacacccccgccgacaagccccatccgggcgcgccggacgcaggccccgcccgcaaggaaaccaacggcgcggggtcgcgccgcgagacgacccgcgacacgagagcggaccgcgagacgacccgcggcacgagggcggaccgcgggacgaccggcggcgcggaggcggaccacgggacgaccggcggcgcgagggtgggcggggagcgggccggcggcgcgggggtgggcggggagcgggccgggggtcgtcatcagcgttcgccccgggcgtaggcgcgggccgcggccatccgctgcacggtggacgggtgcgtggcgaacatcagcaactcccaggtcggcgggtcggggtcggacaggttgacggtgccgaggcggcgttgcatggcttcgaaggtctgcgggtcaccggtcaggtcgagggcgtgccggtcggcacgggcctcgatctgccgggagacgaacgcctggccggggccggcgagcagcccggcaagcgcggccagcgcgagcagcaggccgatcgcccggggctcgccgatcgtgtcgacgccggccagccggagcaggccggtccaggcgccgagcaggtagatcgcgatcaccgcgagcgcggcgccgagcgcgccgagcagggtgccggtgagcacatcgccgtccttggcgtggccgagctcgtgggcggtcaccgagaccacctcgtccggcgtggcctcggtgagcagggtgtcgtagacgacgatccgccgggtggggccgaggccggacacgtacgcgttgaccgcgcgggtgcgccgcgacgcgtcggcgaccagcacgtccttgaccggcacaccgtcggcggcggccagcgcgatcagctcggcgcgcagcgggccggccggcatcggggtgaacctgttgaagatcggctcgacgaccaccggcagcacgaacgacagcagcaccacgagcccggcggcaccggccgccccgaaggcccaccaccagcgtggtgcgaagcgggtgaccgcgaagaacccggccagggccaggccgcccagcacggccgagacggcgaaggatttcagcaggtcggtgccccagccgccccacgactgggtggatatcccgtagcgcaccacgatggtgtgccgccaggccgcgaacggcagggtgagcagctcgccgacgaggaccacgagcagcccgccgagcaccgcgcggcccagccagtgcccgccgaacggccggccggccagctcgaccagccgggcgccgagcggggtgagcccgagcgccagcgccaccaccaggccgagcagcatgctgccgtaggtgccgggacgcagctcggcgcggaactgccgggcccgggcgacctgctcggccgggaatcggccgagcgcggccacctggtcggcacgcggggcgggggcgcggtgccagggcacggtgagcgcggcgaccagcaccagcgccacgagcagcaccccgaacgacaccagggcccacatccggggagtcatggcgaaagatcctatgccgtccggcggagcgcgacccggaccggcggctccggcgtctccagcagctccacctcgagaccggccagctcgaacacctcgatcgcccgcagctcaccgggagtcaggtcggcgatcccgtccggtgtctgcgcgagcacgctgaccaggcacccggtgcactcgtcggtccgctcgacgcaacgaccacaatcgatgatcattacccctcctcgaccaggaggcccggcgcgacgggccggtcacctcaggtgaccgtcacgctaggccgggggtatgacaagaaaatcgccgcgccggtgtacgaggggggctcaggaccgggcgagccggcgcagcagcgaatccgcgcccatcggatacgccccgtgacgacggacaccgtcggcgacctcccggtcggaggagaccaccaccagcggccgaccgggcggctcggcccggaccagctggcggatcagctcgtcggcggtggtgcccttgcgggagaagagcacccgcacgccgcgcggcgccggcggcagcccgtgcacccgctcggccccgtcgaacaccacggtgacctcgtccccggtctgcgcggcgatcccgccgagcccggtgatcaggcgtttgcgctgctgctccagggacatgtcggcgaagccgcgcttggtcacgttgtacccgtcgacgaccaggtgggcgcggggcagcgcgagcagctggtcgagccggcccgggtcgtcggtgtcctgggcgcgggcctgggaccgctcgggtgcgccgggccggtcggccgcggcgtcggccacgaagtcggcgggcagcttgtcggtggggtccagggccagctcgcggcgcaggccggtggccgcctgcccgatggtttcgagcagcagccagaggcgggcgtcgtcgaccgcgcgggcgtccttggcggcctgcttcccggtggccgcggcggcttccgcgtcggcgaggcgcgagcgcatccggcgtacctccgcctcgtggtccagggcgacgcgcgcagcgcggcccttctcggtggctagcaggtcggccgcgcgtttctgggcggcctgggtctcgcgcagcgccttggccgcgacccgcgcctcctcgcgcacctggccgagctcctcgcggacccgggccagctcgtcgcgcagcttgtcggcctcgacccgggccaccgcccggtcgtgctcggcgcgggtggcccgctgctcggcggcgcggatccggtcggccagggcgtggctgtcggcgtcggcccggaccacgtcaccggccgcctcgatcaggtcccgccagccgtccgggcgggccaggtaggccagcgcggcgacctccaccgggtcggccgcggccggggcgaccccgctggtcacggcggcgcccaggtcaccggcgtcggtcacgatccgggcaccgatccgctgccggaacagcgggtcggcggtcagctgggcggcgatctcccggccgccgaggcgggcccgccggttcggtgcgaagcgggcgacccggcgcagcaccaccgggatctcgtcggccggcagcccgggcagcgcggcggcggcgagtgtcatgatccgctgccggacgacctccggcagaatcggctcgggggtgacatccacagccgcggccgccgcctcctctgcggggcggtcgtcggggttcagcggcgcggacatccacccattctcacaccgtggcccgcgaaaacgcttgccacggcaagtgatcttttccaggcgggttcggttaatgtcgtacccccgctctagtgttgcccgccgtggcacaaccggcttatgtgcagggcactctggacacgctgctgtcggcggacggctcggtggatccggcggccgtctcgctggccgacaccaccttcgtggtgctcgacctggagaccaccggcggcgctccggacggtggcgggatcaccgagatcggcgcggtcaaggtgcgcggcggcgtgccgatcggcgagttcggcacgctggtgaacccgggtgagccgctgccgccgttcatcaccgtgctgaccggcatcaccgaggcgatgctgcgcccggccccgccgatcgagacggtgctgccggcgctgctggagttcctgcgcggtgccgtcctggtcgcccacaacgcgccctacgacgtgggcttcctgaaagccgcctgcgcccggcacggctatccgtggccggcgccccgggtgctggacaccgcggccctggcccgtcgggcgctgacccgcgacgaggtgcccaatcgcaagctcggcacgctggcccagttcttccgctccgcggtgcagcccaaccaccgggcgctcgacgacgcgaaagcgaccgtcgacgtgctgcacgggctgatcgaacggctgggcagcttccgggtgcacaccctgggcgacgcgatcgagttcgccaaggcggtcaccccggcccagcgcagccgccggcacctggccgacggcctgccgcacgtgccgggggtctacatcttccgggccgccgacgagcgcccgctctacgtcggcacgtcgaaggatgtcgccacccgggtgcgcagctacttcacggccggcgagaaacgcgcgcggatctccgagatgctcaccgccgcggtccgggtggaggcgatcgagtgcgcccatccgctggaggcggaggtgcgcgagctccgcctgatcgcggcgcacaccccgccgtacaaccgccgctcgaaatatccggagcgggtggtgtggctcaaactgaccgccgaggccttcccccggctgtcggtggtccggcgcttcgccgaggacggcgccacctatctgggcccgttctcctcgcggcgcaccgccgagctggccgccgccggcgtctacgacgccgtgccgttgcgacagtgcaaccacaagctgtcgctgcgcacccgcaccccggcctgcgcgctggccgagctgggccgctgcccggcgccgtgcgagcacgagatcaccccggaggagtacgacctgcgcgccgccgcccccttccgggtcgccacgtccggcgaccccggtccggtgatcgaggcgatcctggcccggctggacacgctgagcgaccgccggcggtacgaggaggcggccaccgtccggtcccgcctgatcgccctgctgcgcgcgctgatccggatgcagcggttggacgcgctgacccggctgccgcaggtcgtcgcggcccgccgggacgaccggggcggctgggagatcgcggtggtccggcacggccggctggccgccgcggccacctctccgccccgcgagcatccccggcccaccctggacgcggcactgttgaccgccgagacggtccttcccggaccgggcccggtgccgtcggccacggcggaggagaccgagcgcatcctggcctggctggagcggggggacacccggctggtggaaacctccggcgactgggtgtcaccggctcgtggcgcggcgcgtttcgcggtcctgctcagccgggccgaggcggccgcgtccgcacaagactcgaccgttcgcctatcggtaactgaccgttcggatgacgcccgctcgcttaggctgtaaaggactcggggacttgtggtgattcacggttgcggcagaggcagccaccacggttcgcgtgccatgcttctcgcacggggcatgacgatcggtgagggggtgtccgggtggacgtcgacgccggccacggcgccgctctcggtcgtgcgctgccggccgccacgtccccgagcccgctcagcttcacccggcggctccgttcgctgctgagcttccagggcaacgacgacgatccggtttcgaccctggccaagacgcaccggaccatccacccggcggccgatgtggcgctgctgcgccgcagctacgcgatcgccgagagcatgcaccgcggccagttccgcaagtccggcgatccgtacatcacgcatccactggccgtcgcgcagatctgcgccgagctcgggatggacaccaccaccctggtcgcctcgctgctgcacgacacggtggaggacaccagctacacgctggaggctctggagggcgacttcggccccgaggtgacccacctggtcgacggcgtgaccaagttcgacaaggcgttctacggcaaggccgccgagggcgagacgatccgcaagatgatcgtcgcggccggcaaggacgtccgggtgctggtgatcaagctggccgaccggctgcacaacatgcgcacgctggacgcccgctcgccggcctcccgggcccggatcgccaacgccacgctggacgtgctggtcccgctctgcgaccggctcggcatccaggcgctcaaacgcgacctcgacgacgtggtcctgttccacctggagccggacgcgttcgcccggatcgacgagcacgtgcgcaaccggcccggctggggtgactacctggccgacgtctccgccaaggcgcgcgtcgcgctgcgccggtcccgggtcgacgccgaggtcaccgcgcgtccccggcactactactcgatctggaaggacaccgtcgccggcggccactcggtcccgctcgacctgccccggatcgcggtcgtggtggacggaccggaaaccgactgttacgccgcgctcggcgcgatccacggccgctggcgcccggtcgccggccggttcaaggacttcatcgcctcgccgaagaacaacctgtaccgctcactgcacaccaccgtggtcggcccggagggacgcctggtcgaggtgctgatccgcaccgagaccatgcatcgatactccgagtacggcgtcgccaccagctaccgatatcccaaggtgtccgacgagccacccggcgccgaccagctgacctggctgaaacgagtgctcgactggcagcaggacaccaccgacgcggcccagttcctcgattcgctccgatgtgacctggccgaggcccagatcacggtcttcgcccacggcaacgcgtacgaactgcccagcggctccaccccggtcgacctggcgtacgagctgggcccgtcgaagggcgaccagtgcctcgccgccaccatcaacggccgcctcgcccccctcagctccccgctgcgcgacggtgacgtcgtcgagatcttctcggagaacgacgggcacgtcgaggtcgagccgaacgccccgcgcggcccgcgtcgggagtggctcggattcgtcaagtcgagccaggcgcagatgcagatcaaccgcttcttcgacgagcggaacgagcccggcatcagcatcgccgacaaggtccgcctgggccgggcgacgatcgggctgaccctgcgcaaacacgaccgcggcctggccagtgaggtgccgttgcgccgcctcgccgaggacatgggctaccccgacctggaaaccctgctcgtcgcggtctgcgagcgcaccgtcgagccggactcggtggtcgagcagctgatcgccatggtggaccacccggactgaggccggtcccgccccgccttccgcccaccccgcaggcttcgttcagcgggccgggctagccttacgcgcgtgaaccttcctcggcagctgcgtggcctcgcgtatcaggtcttctacggcctccccctgccgatgcggcgccacatcgcccgcgcggtctcccccaaattcctggtcggcgcggtggcggtgatccgggacgcggaggccgccgagccgggccgcatcctgctgctgcgccagccgcccggccgcggctggggtctcccggccggcctgctcaagcgcggcgagctgccagccgtcggcgccgcccgcgagctgcacgaggaggccggcgtccggatcgagccgggcgatctgcgccccggcgacccgaacgcgatcgtccacccgaacggcggggtcgtcgacacggtctggttcggctgggtgccggcgtccagcacaccgctggcggtcgacggcggcgaggtcctggaggcccgctggtggccggtcgacgacctgccgaagctgacctggccgacagcccggctgctcggcgtctacgggatcgggcccaaagccggcgagttgcccccgtcggtcccgtcgtccagcgccgccccgtcccgggatctcccccagtgacccaccggccgccccgcccctggagctccccagtgacccactcgcccaccggcccggccgtcgccggatccggtacgccgcgcagtcccgaggtgtgcggggtcgtgctcgccgccggcgaggggcagcggctgcgcccgctcaccgcgaccgtcccgaaagccctctgcccggtcggcaacctgccgctgctcgaccacgccctgcgccgcctggccggcctcggcctgctcggcccggaggacgtcgcggtgaacgcggcctacctcgccgatcaggtcgtcgcgtacgccaccggccgcgcgcacctgtcggtcgagccggacggcccgctgggcacctccggcggcgtcgcccggctgcgcaagtggatcgacggtcgcggggtgctggtcggcaacgccgacgcctacctggccgacccgttccgcgaccccggccgggacatcgaggccctgtgcgacggctggtccggcgacacggtgcgcctgctgaccaagccgtgccgtcccggcgaggccggcggtttcagcggtaaccgtttcgccggtttctccctgcttccttggcggtacgtcgccaccctgccggatgagcacagcgatctcgtccgcaccgcgtggcgtcccgccgaggccgagggcgccctggaactgatcggctacgagggccactacctggacaccggcaccccgtcgctgtatctggaggccaacctgcacgccgccggcgccggcctggtcgacccttctgccgaggtgaccggtacggccaccgggtcggtggtcggtgccggcgcccacgtggccggcacggccaccggttcggtcgtcggcgccggcgcccacgtggccggccgcatcacccggtgcgtggtctggccgggcgccaccgtcgagccgggtgaggacctcgccgaggtgatccgcgccccgggcgggctgaccgtcccggctgccgggctgggtggatagcatggtgccggaacattcgccgcacgggtgaggagacctcaggtgaacaccgcgatcgtccacatcgactgcgccaccgactcgatccccgaggtcgccgaggcgctggccgccctggacggcgtcagtgaggtctactcggtggcgggtggcgtcgatctgatcgccatcgtgcgggtcccgcggttcgaggacatcgccgaggtgatcgccggccgcatctccaagaccgccggcgtgatcaacaccgagtcgcacatcgcgttccgggcgtactccaagcatgacctggaggacgccttcgcgatcgggctgcccgacgccgactgacggtcaccgcagccgttccaggcgatcgcggtaggtgtccagcacccccggcgccagcagcgcccgtggccggaaaacggcgatcaccaggcccgccgcgtccgattcggccaccaccggccgggccagcgagtgcaccgcatcgaacatggcgacggcaacataccggtcaccgaggatcgaccggtaggttgccgcggtctccgcgacgtcgacgttgcggtcgtgctcgcccagcatcagcagcaccggcacgtgccgccccgccatggcccgcagatcggcggtggcgtccgaggtgtagttgcgggccacgaagccccatcgggcctcgtccatcggctccgggtcgccgctgcgggcgcgataggtccgataggtcgcgccctcgtccagaagctgccgggtgcgatcgctgaccgccagggcccggtcgcgttcggcatcgcccgccccgtcgtggctcagttccgcgagcaggttgtagcggccctggcggagccagttgaccgccggaccggccagcacgaccgcgctgatgtcgtcccggacggcgacgatccgcggcaccacccagccggcctggctggcgccccacagcaccaccggcccgtgcggcacgtccggccggccacgcgcccagtcgatcacccgggatgcctcgtctgcccggccggccatgctctgcgcgagccagtcccccgccgagcggccgacgccgggcttgctccaggacagggtcgcgaacccggcgtccgccgcggcctcgaaccacggctggtacagcccgtcgtgggtggcctccaccggcccgtcaccatggatcatcaccaccaggccgcgtggcacgccgccggccggcgtggtgagcacggcgtcaagcgcaccggccggcccggggacgctgagccgccgcacgtcgatccggaagtcgttgccggcgagcaggacggccacaccgacaccgatcacggcggccactgtcgtgatgaccgcaaaaactatcttccttcgcacggtcgtagattagacgatagaatcgagccatgacactggagatcggatccggcttcaccgaggccgagcgaacccgggtcggcctgctgtactgggcggccttcgggcgcaagctgcgcctcgcgttccgcgacgaggccaccggcgtcacccgggtgacggctgcgctgctccccgaccggatgctgatcgcccgggccggcggcgccgtgaccggggtgtgcggcttccaccgggacgggcacggcgcggccgacctctcgtggtcccgcctccgaccccaggccggccgggcgagcgcactgcgcgcgctgctggccctcgccccgctggagcgacacccgcaagccggcgtgctcctgctggacggcgtcgccgtcgacgcggcgctgcgcggacgcggcatcggatccgctctgctggccgccgcggaggaacaggcccgtcggcagcatgcccggtgggtgcagctctcggtcgtcgacaccaaccctcgcgccgaggcgttgtaccgccggctcggataccagccggtcagcaagggatcgatcggcactctgcggcatctgtacggcttcgagcgtttcaccacgatgcggaagaggatcagcgcgtgacacccgctccgaggaccgtcgtcgaggcgttcctgcccgccgacggcgcggccgcactggaccagctctacgacaccgccaacgccgccgggctggacgaccagccggtgcgcctgacgatccggcgaatggtcgccgccggcgaggtcacccagtccgggcggggccgccgcggcaccctcgcactgaccgccaccggacgcgagcgcctgcgccgtgaccggctggcgctgcacctggccctcgcccaggaccgcgggcaggccccgtgggacagccggtggcggttgctcgcggtcagcgttccggagacggaccgcgccgcccgggacgccatgcgccgtgaccttctggctgccggggcggcgccggtctccacgggtctctacgccagcccgcacgacctgagcgcgatgctcggccctctcgacaccagcgccaccgtcgccggcactccgggcgcggacactcccggcaccggcgcgttgttccgggccatcgccaccgacctcgacgtgcgcggggtgaccgaccccgccgagatcgccgagatgctctggccggcggcgccgatcatcgaccggtacgccgtcgccgaccgggccgtcgagctggccggttccctgcggcccggcgccgacacccgagccgtgctgctgcgccagctgcgcctggccgatgcgtgggaactggcgatgcgacaggacccgctcatcccgccggaactgcgtggcgacccatggcctcccgccacgatccggcgccggtggcacaccgcctggacggagctggccgcccagctccccgatcagctgctctaccgcggctggctgccctgaccccgacgaacccggaaaaaagatcggcccgccggcggaagccgacgggccgatctcctgcgtatctcagcgcttggtggtgatctcctcgcgcttggtggcgccgatcggagccggcgacaccggcgcctcggccggcttctcgatcgggaagaagaagcccttgaccgccggcgcgagcgccccgatcttgttcatcttcttcggcacgacccagccgcggtactccagcgggatcgggtgcccgtgctcgtccaccgggccgagcggctggtggatctcgacgaacttcccgttcggcaggcgcttgatgatgccggtctcgacgccgtgggccagaacctcccggtcgtgctgctgcagaccgagacagatccggatcgagacgtagtaggccagcgggggcaggaccagcagaccgatgcggccggcccaggtcatcgcgttcaggctgatgtggaacttgtcggcgatcacgtcgttgccgccggagatcgtggcgaccaggaagaacgtgaaggccatcatgccgatgccgacgcgctcggggttgtcccggggacgctgcagcaggtggtgcgaccggttgtccttcagcttccgcgcttccagccacgggtagagcatcggcagcgtgaacagcgcgccgaggccgaccacggcgggccagaacagcggcgggatgctgtagccgtcgccgaacgggatgtagatctgccagttcggcatcagacggaccaggccgtccatgaacatgacgtaccagtcgggctgcgaggccgaggagacctcggaggccaggtacggcccgaacagccagatcgggttgatctggaagaggccggccatcagcgcgatcacgccgaagaccgccatgaagaagccgccctgcttcatcgcgtaccgcgggaacatccgctcgccgaccacgttctcgttggtccgcatcgggcccggccactgggtgtgcttctgcttgaacacgatgcccaggtgaacgctgatcagcgcgagcaggatgcccgggatgagcagcacgtgcgcgatgtagaaccggccgatgatcagctcgccggggtactccccaccgaagatcgaggcggacagccaggtgccgatgaccgggagggacagcatgatcgccgaggcgatgcgcagaccggtgccggacaggccgtcgtccggcagcgagtaaccggtgaagccggcgaagaacccgagcaggaacagcaggacgccgatcacccagttgatctcacgcggcttgcggaacgcgccggtgaagaacacgcgggccatgtgcaccacgatcgacgccatgaacagcaacgccgcccagtggtgcatctggcgcatgaacagaccgccgcgcacctcgaacgagaggttcagcgaggactcgtaggcgccggacatctgcacgccgtgcaggcccaggtacgacccgtggtaggtgacctccttcatcgtgggatcgaagaagagggtcaggaacacaccgctgagcagcagcacgatgaacgagaagagggcgatctccccgagcaggaacgaccagtggtcggggaagaccttgttcaggagcgcccggagcggggtggccgcctggaagcggtcatcgacgcccttggcgaagttggctgttgcctcggctggatctagctttcggcgtttcacggccgctcccagaagtcgggtccgacagtgtccttgaagtcagacgttgccacaaagaaaccttctgcgtccaccgacagcggcaacatcggcagacgccgggtggcggggccgaagaccggctgcgcgttgtcggtgatcaggaactgcgactggtggcacgggcagagcaggcgattcgtctgctgctcgtacaggctggccgggcaaccggcgtgggtgcagatcttcgagtacgcgacgtagttaccccacatcgagcccttgttgcgcccgttcttgtcgctgtccgcgttggcccgggccttggcggcgtcggcgtcacggaggtggatcagcagggtcggcgagtccgcgtacctgttggtcgccccgcccgggatgccggggaaggccgtcatctgaccgcccgcgctgacgtcctccggacggatcggggtcccgtcctcccgggtgagccggaccggcttgccgccgttgggcaccgggtcgaagccggtgtggtccatcatctgctgcggacccttatgcggattctggatcaggccgccgaccagcggggccgccgcggccaggccgagtggggccaggccgagaccgatcgcgcccttgagcagcgggcgccgctgcacccccagctcgtccgcgacgtacatcatggtctggccggtgatcagccggtcctcgtcgctggacgggtcgccgtgccgctgctggatcgacagctcgtgcggcagcagtttcttggcccaggccaggatgccgatgccgagcgagaagagcgacagacccagggtcaccccgaggatcggcgtgaagaagtcgctcctggtggtgcccagggcccacttccacggccacacgatgtagaagaccaggaaggccagggcggccaggccggagaagatgaacaggaaggagatgctgcgcaccatgcgccgctcggccttcgagttcggacccgggaactgcgactcgtacgtgacgatctcgatgtcgtcgcgccgcaggccctctttgacgatgtcgaagcgggtcagcttcggatcggtcacgtcgaccggctcgccggcgacgccgtggtgcgctgtcatgacttccccgcaatccagagcgacgtgaagaccaggatcgtgatcccgaccaggaagatcgccaagccctcggtcgccggaccgtaaccgcccaggttgaacacgccacccgggtccttgttctgctgcagctgctgcgtgatgtaggtgatgatctcgcgcttctggtcgggcgtgagctggttgtcaccgaagaccggcatgttctgcgggccggtcagcatggccgcgtagatctgctccgccgtggcgtcgtgcaggctcggcgcgtacttgccggacgagagcgcaccaccggcgccggtgaagctgtggcaggaggtgcagttcttccggaagagctcgccgccgcgggccagggcctcggggttgttcttcaggttctcgaccagctcgccggtcgggatctgcgggccgccaccgatctcctggatgtactgcgcgatctgcttgatctcatccggggtgaactgcggcttcttctgctcggcctgcgcctcctggcgggtcatcggcatgcggccggtacccacctggaactcgaccgaggccgagccgacgccgatcaggctcgggccgcggtcctggacaccctgaccgtcccgcccgtggcaggtgatgcagctgttgtcgaagagctccttgccctgctgcgcggcggtggagagctggctgttgtcctcagcgaaggcgccaggggtgaaggcggtgtagacgccgccggcgagcgcgagcgccgcgagcatgcgcaccgccgcaccgacccggcggcgtgcccggctgggcgcgccgcggcgccgggagaacacccgggcgcgcctgcgggcgggggtgtcagaagtcatgggcttatgtccctctggattgaacctgaagctcagcggatgtcggcggcggtcacttcagccaatagatcatggcgtacagagcgatccagacgacgtccacgaagtgccagtagtaggacacgacgatcgcggacgtggcctgcgccggggtgaagcgccccatggtcgttcggatcatgtagatgatgaaggcgatgaggccgccggtcacgtgcagaccgtggaacccggtggtcaggtagaacatcgagccgtacccgtcaccgttgagcttgacgccctcgtggaccaggttgcggtactcgttcgcctggccgagcacgaagatcaggcccatcacgaaggtgatcgtgaaccagcgccgcagcgcgaacacgtcacccttctccgccgcgaagacacccagctgacaggtcaccgacgacaggaccaggatcgtggtgaaggtcgtggcgtacgggatcttgagctctctggtgtgctccgcccacatgccgggggcggccgcgcgaatggagaagtacatggcgaacaacgccgcgaagaacatgagctcactggagagccacacgatcgtcccgacgctgaccatgttcggccgagtgagcgagtggatccggctcttgtcgatggctgccgctgtcacgggctcattattcccccgcggtaggcctaaggtcaggcggggtccccaatccggtcaggcgagccgcccgcaatattcggtgaccagggggtaggtctagcttttcaagggtgcagtcagtcgaatttgcctcgctggcggacgggtccggggatactggactcccgcccttcaccgcggccgcgatcttcacccggttccacttcgtcagcctgatcgcggtgggtctgctggtcgccgcggcgctctacctgtacggcgtgcaccggctgcggcagcgcggcgaccactggccgggtggccgggtggcggcgttcgtcgccggtggactcggctcgatcgcggcggtctcggtgaccggcatcgagggctacgacaccacgctgatctcggtgcacatggtgcagcacatggtgctgtcgatggtgggcccgatcttcctggccctgggcgcgccggtcacgctggccctgcgggtgctgcccacgcagccgcgcaaggccctgctcgcggtggtgcacagcgggttcgtccgggtgctgaccttcccgctggtcgcgttcggactgttcgtcgcgaacccgttcatcctctacttcacgccgctgtaccggcagacgctggagcacgcctggctgcacgagttcatccacgtgcacttcctgatcaccgggtgtctgttcttctggccgctgctcggcctggacccgctgcccaaccgctggccgtacccggggcgggcgctgctgatggtgctgtcggtgccgttccacacggtgctcgggctgaccatcatgcaggcctccgacctgctcggcggcgactggtacccgagcctgcacctgagctggatggatccgcatgccgaccaggtcaccgcgggcggcatcctgtgggccggcggcgagatcgtcagcgtcacgatgctcggcatcctggtgatgcagtggatcaagcagtcggagcgggaggcccgccggatcgaccgggccctggaccgggtcgagatggaggaggccacggcggccgccaagatcacagatccgccgaacacggatcgcccgggccccgaggccggataacagatccgatacgatcggcgggacctccgaggtgaagtggggcacaaagttgagcgacacagccacgacccagtacacggttctgctatacagcgacgacgccgcggtgcgcgaccggatccggctcgccatcggcacgcgtccggcggccgatctctccgtcgagttcaccgacgcctccacctgggaggagtgccggcgactgctggacgactacgagatcgacctgatggtgctcgacggtgaggcgacccccgccggcgggctcggcatcgcccggcagaccaaggacgagtatccggacccgccgcccacctgcgtcgtgatcgcccgcgcggcggatcgctggctggcagcgtattcgcaggtcgacgcgaccctgctggccccgctcgacccggtcaccaccggccagacggtggccgggctgctccgcgcccgccgctccggcgtggtcccgctgggcgccctcccccgcacctgaccaccgcaccacaccccccgacgaaaggccccgccatgggcgcacgcacctggccgaatctgacgagttccctgctgcgtggcgaggaactcgccgccgcggacacggcctgggcgatgagcgagatcatggcgggcaacgccacgccggtccagatctccgggttcgccgtggcgctgcgcgccaagggcgagaccccggccgagctggccggcctggtcgaggcgatgctgtcggccgccaccctggtggagctgccgccggagacccgggccgccgctgtcgacgtggtcggcaccggcggcgaccgggccaacacggtgaacatctccaccatggcggcgatcgtcaccgcctccgccggggtgaccgtggtcaagcacggcaaccggtcggcgtcctccaccaccggcaccgccgacctgctggagcacttcggcatcccgctcgacctcggcccggccggggtgaaccggacggtcgcggaggcgggcatcggcttctgcttcgccgcgcggtaccaccccggcatgcggcacgcctcggtcacccgccgtgagctgggcgtgcccaccttcttcaacatgctgggcccgctgaccaacccggcccgcccacgcgccgcagcggtcggttgcttcgagccgcggatggccccggtgatggcctcggtcttcgccctgcgcggtgactcggcgctggtgatgcgcggtgaggacggtctggacgagttcaccacggcggcgccgacccggctgtggctggcccgcgacggtcgggtcgacgagatgctggtcgacgccaccgagctgggcctggcccgcagcgagccgaacgcgctgcgcggcggggacgcgtcctacaacgccgacgtggcccgccgggtcttcgccggcgagtccggcccggtccgggacgcggtgctgctcaacgcggcggccgctttcgcggcccagggcggcttccccggtgatttccgcgacaccatgcgggccggcatcgcccgtgccgccgaggcgatcgactccggcgccaccaccaagctgctggaccgctgggtcaccgccgctcgagccgccaagaccgccgaataaccggcgtacgccgtcatccccgccccggccccggtaggcagccagggcacgtccagcggtcgcctgcgccccggaacggcgtccatcggggccggaacctcacccggacccgcggaacgcgctcaggggcggtcagcgactgcgacagaatgggtggtttgagggcactagttgctgaaaaatctggaaaaagactgcaacacaccgccggtgatgctcggaatcacccgcggggcgtgacaacgtctgaaggacattcgggtaatcccaccttcccgacgaaggagaagcccgtgcacgaacgtgaactgcgctgcgtcatctgcgacggcgacatgctgttcgagacaccgccctgcgacgacgggcacgacgactgtcccgagctggtctgcacccgctgcggtgccgccgaggtggtcgccccgatcgtcgtccacctgtggatggagccgaagggcccgcggcgcatcgccccgcatcagcgcaccgccgccgcctgacccgcggcaccggaccgccccgcggctgcgggcccgccccgcggcggccaccgggctgacggcgtaccgcggcgatcgagtgaaccggaacgccggcgggccgcaagccggccggcgaccccggaaaaggcggaagcccgcgttccccggaggggaacgcgggccaccggagaccggacggagctcagtgctccgcgggctgccgggtgctgctgtagtactcgaagagcatcccgcaagccgtgaagatcacgcagagcaggccgaacgccagcagccaccacatccagaacaccaggcccagaccggcgatcgccgcggagaacgcgatgccgaacggccagtagctgcccgggctgaagaagcccagttcgccggcgccctcggcgatctcgccgtcctcacggtcctcggggcgcaggtcgatgcggcgggcgacgaaccagaagaagccgccacacatcgagcagagcaggccggacaggatcagcgcgacggtgccgacccactcggtctggtgctgctggcccttggtgtacaggccgtagacggtggctgccccgaagaggaacagggagacacccaggaagatcttgtattcggtcttcacgtcgtaacccctacttccccgcggcgacagtgctgccgctctggttccaggtgtgcgtgccgcggcgggtgtcgaacggctgcgtcttggtcgcgaagggctgctcgccgatcgcgctcagcgcgtcctgcgtcgactggccggccttcttcgccgccaggaactggtcgaacttggcctggctggtcgcgaccagctcgaagttcatgaacgcgtggtacgtgccgcagagctccgcgcaccggccgacgtagcggccctccttgtcgagggtcacctcgaacacgttgcggatgttgccgggcatgacgtcgcgcttgaacagcagctccggcacccagaacgagtggatgacgtccttgctggtctcctcgaagcggatcttctcgccgaccgggaggaccaggatcgggatgacgtccgaggagcccacggtggacgcgacggtgtgcgcgtccttgcccatgccgtcccggtagtcgaactcccagttccacttgaacgcggtgatctggacgatctggtcggggttcttcgacagcttgtccacgtcggtctggacgatcgcggtgtagtagaagagcaccgcgacgatcagcaccggggtgaccgtgtagaggacctccatcggcatgttgaaccgggtctgcacgggcagctcgtcaccgcgcttgcgataccggatcacgcaccagaagatcaggccccagacgccgacgccgaccaccagcgcggcgatcaccgaggcgatccacaggtcgtacatctcgtgggcctgcaggctgacaccccggccgggccatccgaagtggccgaacttgctcccgacgtcctcgaccgagcaaccggcgagcagcgccagcagcatcgcgccgccgagacccagcccggccgcccggccaatcgcccgcggccgtgtggccgaactccttgcgcccacctgcttctgcctccttagcagcgccgccgtcgcccgaaacggacacctggcggcaaggctcaccgacggtcgcacactactcgaccagcgccgggccacccgccaccgggggcctcacgcgagaccttgaggattccccagacaatcggacgataccgttccctctgtggattacacaggcgatccgccggtctacctggacgcggccagcgccgcgccgctgcatccggtggcccgggaggcgatgctcgcggcgctcgccgacggctgggccgatccggcccgcctctacgcggcgggccgccgggcccagcagctgcaggaggcggccacgtcggtggtcgcggaccttttgggcgtacgcgccgacgagctctcgttctggccctccggcgccgccgcggcacaggcggcggtgctcggcggcctggccggccgccggcgggccggccgggtgctggtgcactccgcgatcgagcactccactgtgctgcacgcggccgccaccactgaggccgttgaggtgggtgtgacccgtgagggccggctcgacctggccgcgtgggccgccgcggtggccgcccccggggtggccctggccagcctgatcagcgccagtcacgaggccggcacggtgcagccggtggccgccgccgcggaatactgcgccgaggcggggatacctctgttcgtcgacgccgcccagtccgtcggccggatcccggtgccgccgggctggtcgctgctgagcgcgagcgcgcacaagtggggcggcccgccgggcgtcggcctgctggtggtccgcaaaggagtgcggtggatctcacccaccccacaggatgatctttatcgcccccgtccgccgggcgccgccgacctgccggcaatcgtcgcggcggcggccagcctgcgcgcggtgaccgccgaggcgcgggccgaggcggtgcggctgagcgccctggtggaccggatccgggagcgggtggcggccaccgtcgaggacgtggagatcgtcggcgacccggtcgaacggctgccgcacctggtcaccttcagctgcctgtacgtggatggcgagacgctgctgcacgcgctggaccggcacgggttcgccgtctcgtccggctcgtcgtgcaccgcctcgacgctgcggcccagtcacgtgctggaggcgatgggggtgctcagccacggcaacgtgcgggtgtcgctgcaccgcggcaccaccgaggccgacgtcgaacggttcctggcggtgctgcccgggctggtcgccgagatccggaaggaggccgggttctgatcaccctggactgcctcggcctcaagtgcccgctgccgatcatccggctggccagggcgatgccgggggtggcgatcggcgagatcatccgggtgctcgccgacgatccggccgcggccaacgacatccccgcctggtgccgcatgaagggccaggagttcgtcgccggccacggccagcggttcgacgtgcgaaggactacctgaggtacgcgacgacctgcggcgccgggtcctgggcgaggtgggtgtcgaccaccaggcgcggacccaggtaaggctcgtactccgactggcgttccagcacccgcacccagtcgggcacgccctcgtggtcgcgggtctcgtagcgcgcctccacccggcggcggtgctcggcgtcgtcaccgcacaccacctccaccacgcgcaacggcaccccgatccggtcggccagctcgacccagaggtcgcgggccgccttcaccgggctgaccgcgtcgatgatcacgtggtggccgatccggagctgcgcctcggccagggccgcgaccacgccgtacgccgcgtagccgggccgcggctcgtgcaccgcgtaccgctgcagggcgaagtcgacggtgtcgaccgcgagcaccgcggccggcagctcggcggcgacggccgcggccagggtgctcttgccgaccccggggaggccggcgaaaaccgcgagaaccatgttcctgtttctatcctcaggccggcaggtgcggcgcgatctcggcggcggcggcctcgccgtacgccgcggcgaagcgcttgccgaagtcggcgggccggatctcgtattcctgggtgccgaccgtctccagcaccagcgcggcgaccagcgagccgacctgggcggagcgctccaggccgaggccccaggagatgccggagaagaagccggcccggaagccgtcgccgaccccggtcgggtcctcgccgatcacgtccgggacgaccgacacgtggatccgctcgatgcccttgccggtgatctcgacgccgtccttgccgagcgtggtgacccggatccggacctcgtcgaggacctggtcaccggacaggcccgacttggtctccagcagcgagcgctcgtactcgttggtgagcaggtagtcggcgccacggatcaggctgagcacgtccgagccgtccatccgggccaactgctgcgacgggtcggcggcgaaccggtaaccccgggtgcggcactcctgcgagtggcggatcatcgcggccgggtcgttggcgctgatcagcaccaggtcgatgccgccgaggcggtcgacgaccggggccagctcgatgttgcgggcctcgctcatcgcgccggcgtagaacgacgcgatctggttcaggtcgtcgtcggtggtgcagacgaatcgcgcggtgtgtgccacgtcactgacgtgcaccgagccgcagtccaccccgtgccgctccagccaggaccggtagtcggcgaagtcggcgccgaccgcgcccagcaggatcggccgcagaccgagcttgcccatcccgaaggcgatgttcggcgcgacaccgccgcggcgcaccaccaggtcgtcgacgaggaacgagagcgagaccttgtgcagctggtcggcgatgagctggtcggcgaaccggcccgggaagtgcatcagatggtcggtggcgatcgagccggtgacggcgatcttcatggcggccctttagaggtggggaacaggggtcgttacagatggagactaccgggcggttacgcggaacaggccgccccgtgaacgggacggcctgctcggcagtacgtggatcagctgaacgagtcgccgcaggcgcaggagttgcccgcgttcgggttgtcgatggtgaagccctgcgcgtcgatccggtcggcgaagtcgatggtggcgcccgccaggtaaggcgcggacatccggtccaccacgacctcgacgccgtcgaagtcgctcacgacgtcgccgtcgagcgagcgctcgtcgaagaagagctggtagcgcaggccggagcagccaccgggctgtacggcgatgcgcaggcgcaggtcgtcgcgcccctcctgctcgatcagggccttgaccttcaccgcggcgacgtcggtgaggatgacgccggtcggggcggtcgcctcggtcgactcggtgtgcgcttcagtggtcactaggtatctccctgccaggtgcggtcatgtgccgtaccaggcaacgctaaccccattcccgcagattcccaatccgggcccactgagatcagcgactccactgggcggcgatccgttcggccagttcccgcaggccacgcgccggttccgccatcgcctgccggaccgaaccgaaatgctccaccagggtgtgcgtctcggtcacgcccgccgccgcggcctcccggtacccggtctcgttgcggccggccagcaccacacacggcaggccgcggtcacgggcacccccggcgatcccggccaccaccttgccgcgcagcgactgatggtcgaagctgccctccccggtgatcaccaggtcggccgcgtccagctcccggtccagcccgaccaggtcgctgaccagaccgatccccgaggtcacccggccaccgagggcgatcagcgcggcaccgatcccgccggccgccccgccaccgggccggatcgccagatcttcaagatcaaaggccttctccagtacgccggcgaagtgcccgagggccgcgtcgagacggagcacgtcctggcgggtcgcacccttctgcgggccgaagacgttgctcgcgccgtgcaggccggtcagcgggttgtccacgtcggtggccgccaccagggcgacctggcgcagccgcgggacaccgcccagcgcggccgcggcgatcagcgcggcgccgccgtagggcagggcgtatccggcctcgtccagcggggcggcgccgagcgcggcgagcatgccggccccggcgtcgttcaccgccgagccgcccaggccgatcaccacctgcgcggcgccgctctccaccgcggccgtcagcagcaggcccagcccgtacgacgtggtcgtggtgggatcgcgctcttcggtcgtgagcaggtgcaggccgcaggcctgggcgctctcgacgtaggcgaccccgttcgcgtacaggatctcgcccgccaccggccggcccagcgggtcgaccgtgcggaccgggatccggcggccgggcagcgcggtggccagcacctcgacgaagccggggccgccgtccgcgatcggccgcagcaccagctcgtcggtggggacggaccacccgtcggcgatcgcctgggcgacttccggggcagacagggtgccggcgaacttgtccggacagatcagtacgcgcaccccggcagtgtggcagcacacgccccgcgggcgcagctaccgtcccacgccctgtgcaacgatgttcagcgtgacgtcgacctggaccgaacccgcaaacacccccgtcgcgctgctgcttctcggcaaaggcaccgacccggcgagcgagcggggcgtggactgccccggcgatctgcccgcacccagcgaccccgacctggtggcccgcgccaccgcggccaaggccgcactcggcgaccgggtgttcgtgctcgggcaccattaccagcgcgacgaggtgatccagttcgccgatgtcaccggcgactcgttcaagctggcccagcaggcggcggcccggccggaggcggagttcatcgtcttctgcggtgtgcacttcatggccgagagcgccgacatcctgaccaagccggagcagcgggtgatcctgcccgacctcgcggccggctgctcgatggccgacatggcggtgctgggtcaggtggagacggcctgggagcacttccaggatctcgggatcgcgaccgacatcgtcccggtgacctacatgaactcgtcggccgacatcaagggcttcgtcggccgcaactccggtgtggtctgcacctcgtcgaacgccaagcgcgctctcgactggtcgttcgagcagggctccaaggtgttcttcctgcccgaccagcacctgggccgcaacaccgcggtcctggagatgggcttcgacctcgacgactgcgtgctgtacgacccgcacaagccgcacggcggactgaccgacgagcagctgcgcaacgcccggatgatcctgtggcgcgggcactgctcggtgcacggccggttcaccctcgacagcgtccgcgaggtgcgcgagcgggtccccggggtgaacgtgctggtccacccggagtgccggcacgacgtggtccgcgccgccgaccaggtgggctcgacggagtacatcatcaaggccctggacgccgcgcccgccggctcggcctgggcggtcggcaccgagctgaacctggtgcgccggctcgccctggcccacccggacaagcagatcatgtttctcgaccggacggtctgctactgctcgacgatgaaccggatcgacctcccccacctggtctggacgctggaggagctggtcgccggccgggtgccgaacgtcatcacggtcgacgagaagaccgcccgcgaggcccgtgtcgcgcttgatcagatgctcgccctgccgtaacgctgcgtagccgggagatttcaccccggagggtgattgcccggctactcggttttcgggccgcgcgtggactggcggagttgtcactcagcgctatgcttccccggttgcggaagcgggtacccccacccgcgttccgccccctcgattcccctcgggcacaacacgcccaccggctggaggttacgttgaccgacgatgtcctgatcgtgcacggcggcacgccgctgcagggacagatccgggtccgtggcgccaagaacctggtttccaaggcgatggtcgccgcgctgctcggcgagtcaccgagccgcctgtacgacgtcccgcgcatccgcgacgtcgaggtcgtccggggcctgctcggcctgcacggcgtcaaggtcagcgacggcgccgaggatggcgagctggtgatggaccccacgaatgtggagagcgccagcaccgacgagatcaacgtgcacgccggctcgagccggatcccgatcctgctgtgcggcccgctgctgcaccggctcgggcacgcgttcatccccgacctgggcggctgccacatcggcccgcggccgatcgacttccacatcaaggcgctgcgcgaattcggcgcggtcgtcgacaagacgcccgagggcatgcatctgagcgctccgaacgggctgcacggcgccaagctggaactcccctacccgagcgtcggggcgaccgagcaggtgctgctcaccgccgtccgcgcggagggcgtcaccgagctgcgcaacgccgcgatcgagcccgagatcatcgacctgatctgcatcctgcagaagatgggcgcgatcatcacggtgcacaccgaccgggtgatcgagatccagggcgtgccccgcctctacggttacgagcacaagccgatcccggaccggatcgaggccgccagctgggccgccgccgcgctcgccacccgcggcgagatcgaggtgctcggcgcccggcaggccgacatgatgaccttcctcaacgtgtaccggaacatcggtggcgagctgaagatcaccgacgaccgggtggcccggcacggggtgaccggggccgagggcggcatcaagttctggcatcccggcaacgagctcaaggccgtggcgctggagaccgacgtgcaccccggcttcatgaccgactggcagcagccgctggtggtcgcgctgacccaggcacgcggcatctcgatcatgcacgagacggtgtacgagcagcggctcggctacaccgaggcgctcaactcgatgggcgccaccatccaggtgtaccgggactgcctcggcggcaccccgtgccggttcggccgccgcaacttcatgcactccgcggtgatcgccggcccgtccaagctgcacgccgccgacctggtcatccccgacctgcgggccggcttcgcgcacctgatcgcggcgctggccgccgagggcacctcacgggtctacggggtcaacctgatcaagcgtggctacgaggacttcgagcagaagctggccgccctcggcgcccacgtcgaacgcccctgagctgctttttcatgtcgatcaacggcgcggtgtacgacacaccgcgccgtttggctacgctcgtgtcgtgtccccgctgtttcgccgcaagccagccgacctcgtcgaagacgccaccgcctcggtgaccgagacgccgtccgacgacaatcgccgcaagaactacacgcccagcaagaaggagctgggcgtggtcacccccaagcgcgccccgcagggccgccgggtcgaggcggcgccggccgaccgcaaggaagcgctcaaactgatgcgcgagcggcagcggaccgagcgcgccgaggcttccgagggcatgcgcaacggcgacgagcgcttcctgctcgcccgcgaccgcggtccggagcggtccctggtccgcgacatcgtcgactcccggcgcaccatcggctcgttcttcatcgccggcgcgatcgtcgtgatggtcggctcggtgatcaagaaccagtcggtccagctcgccagcaacctgctgtgggcactgctcgccctcgccgtcgtggtggacagcgtgttcatcgcccgccggatcaagaaagcggtcaccgcccgcttcccggacacgacgcagcggctgggctcgctctacctgtacggcatcatgcgcggcctgaccttccggcggatgcgggtccccaagcccaaggtcgagctcggcgccaagatctgagccgctagaacgggacgccgccgcgccacaccgcgatcggcccgaccgtcatggtgcgcgggaaaaccgtcgccgagctgtccacgtcgcccgcgacggcgatgttgagcagcaggtagtgcggcttgccgaacggccagacccggccggaggcgttcgcgtccgaggcccacagggtcatcgtgggcgcccggtcgacgtagaagcgcaccacggacgcgtcgaaatagacgccgaaccggtgcggcgcgacgtccagtggcatgccgaggtcggtggtggcgccgccctcgccccagccgtactgccggtcccggccgggatcggtccggtccgccaggtgcgccgccgatttcgccagggtcggctgtgcgccggtgccctcgaacacgtccagttccccgcaggccggccagccgaccgtgtcgatcgccgtgccgagcagccagaaggccggccagacaccggccccgaccggcgcggtcagcgccgtctccacgtacgagccggccgggatcgacaccttgcccttggtggtcaggcgggcactggtgaacccggtgccggcccgcagggcggtcagggtcagctgcccggacccgtccagcgcggcgttccgcggatcggcggtgtaggtctccagctcgccgttgccccagagaccggcacccacatcgtggttccacacggcggcgtccggcgccgacccggccggcccggcgaacgacagcacccgggccggggcgccgctcacccggggcggcaccggcgcggcgaccgcggtcaccgacagcgcggtcacctgcagggtgaacgcccgatcggccggcaggctcagatagaacgcggtgtccgggcaaccggccgaggtggccacgaacgtccgggtgaccgggcgccacccggtgccgccgagcgtgacgaactcggcgacgccgctcggccggtgctcccaggcgccgttggccagctggatgccgaaccggccaccgccgccggccacatcccgcacccaggccgtcatccggtaggtgcgccccgcgacgaacgagacgttctgggcggcgagcgcgtaggcccacgcaccggatgcggccggccggctcagctccaccgcggtgccggccggggcgccccgcaggccggacacccggcgcaggcccaccgcaccggcctgcgcggtggccgtccagccggtcaggtcccgctcggcggagccgttcagcacaccggcgccggaggtggcggcccgggccgcggtcggcactccggaggcgacgagcgcggcggccgcggcggcggcgagggtacgacgtctcatggcggtcaccatcggcccgcgcgcccggcccccgagccggaccgccatcccgcacccggatggctacccggcgtacaggcgggcgaccacgtcctcgatgtccggctcgacgaccgacaggtcgcggatcggcacggcggcgaccagggccgcgaccgccgcgcccgcggtgatgtcgtccagggcgaaggtgacccggtgccggtccgcctcgaccccggtcagggtggcgccgggcagcgcgaaatcgggtgggagcggggtggtcaggtcggcgaccacgctgcggcgcgaaccgtaccgggcgtgcagcgcctcgatcgaaccgtcgtgcaccacccgaccgtgatcgatcaccaccaggcgttcacagagccgctcgatgtcggccaggtcgtgcgtggtcagcaccagcgtcacatcgccggtcgcgccgagctcggccagaaacgaccggaccgcctgcttgctgaccacgtccagaccgatcgtcggctcgtccaggaacagcacccgtgggccgtgcagcagggcggcggtcagctcgccgcgcatccgctggcccagcgacagctgccggaccggggtgtccaggaacgcgtccagatccagcaggtcacggcagcggcgcaggcgggcggcgtgctccgcggcgggcacccggtagatgtgccgcagcagccggaacgactcgtgcagcggcagatcccaccacagctgcgaacgctggccgaagacgacgccgatccgcagcgccagccgggtgcgctgcgggaccgggcgcagaccgcacacctccaccgtgccgctggacgggctgagcaccccggtcagcatcttcaacgtggtggacttgcccgccccgttggggccgatgtacccgaccatctcgcccggctcgatggtcaacgacactccgccgaccgcctcgacgacgcgtttctcccggcggaaacggccgttcttcacgcgtaccgcgaaatccttgcggagatccttggtcttgatcatgatccggtgctcctgtaatgccggatgccgacccgccagacggcggcggcgacagcggccgcgaccagcgcgaccaggggtgcggcgaagccggcccaggccggcaggcccagcgggtccgggcggccgagcagcgccagggcgggttggtaggcgacgaaggcgaaaccgaggccgtacgcgaacaggccgcggaaccacgggccgtacaccgtgatcggatacgacgcgaaatcccgcccgccgtaggtgaacgcgctgcccagctcccccgaatccacccaccagaaggccaggctcgcgctgatcacgaagatcgcgccgacgaacaccgcgcaggccagcggcgacagcgcgaccagcaccacccggcccggcgtccacgcgatgtggttcagccggaccgcgaccaccagcacgccacacccgaagatcacccgcagcagcttgcggatcggcaggtccatcagcagcagctgcggcagcgcgcccagcggccggaccagcaccgcgtccagcgtcccggcccgcacatacaccttcagccggtcgacgttgcccaccgcgaaatcggccagcgcgaacccggccgagacgagacccgtgatcagcaacgcctcgggcagcgtgaacccgccgatccggtccgtcgcccggaacagcaccagcacggtcagcacgtcgaagaccgtcgcaccgacgttcgccagcagctccaccaggaacgacgcccggtaggagagcaccgaccgggcctgcgcggccgccagcgcgacatacgcccgcagctcacccaccctgcaccaccaggcgacgctcggcccggcgctgcacgaacccggccagcgccagcaacgccaccgcccaacacagctggaccccgaccagggccagctgcaggcccggaccgtcccgctcggcggccacatccaacggcgactgcagaatgctcggcagcggggtgcccagccggagcgccgccgccagccagcccggcagcagccgcaacgggaaatagagaccgcccagcaccccggcgccgagcgtccagaacatgatcgggccacgcgcgtcctgcaaccagtacgcggtggcgttcaccagatagcggcagccgaagctgaccaccaccgcgagcaacacggacagcaggaacagcggagccgtctgccagcgcgccggcgcccgcatcgggaaacacagcgcgccgacggtgagcagcaccacgaaccgggtgagcatgccgtgggcggctcggcccaggtcagcggccagataagcggtcaccggggggactggacgtaacagatcggccgcgacgtcacccgtccggatccgttccgccagctccgaccagccccacaacatgaccacactcagtagtccctgacccagccacacgtacgtggcgagctgctcggcgtcataccctcccgggcgtcccccgtgtgtgccggccgccaccgcgagcagcacataacagcgcaggtagccgaacaccacattggtgaacgttccggccatggtggcctgacgataggtggtgtagcgccggaaacccgaccccaccagtgcaccgaaagtagtggtccatccccggaacggaccatccggagagatcgtgagcacgctggcgtccttcccggccacgccgctaatctcctttcactgacccgcagtggagccgggagactgtacccgggtccccggtcggccacggcccgattaatcacacgttggagttcgccgtgacggagcgttgccaatcgccgggcccggtcgcccgatgaacggttggagctcccgcccgggcgcggacggctgggacgacgaaccggcgtgggtgtacgagatcacctgggagtgggagccgctttccggacagcgctatcccggtgacccggggcggcgcaaagccgtgcacacaccggtctacgaagccaaccgcggacagacggcgccgggcgtccccggtcccggcggtcccgcggcgcacggacacgggcggaccccggacgaggaaccgcagcggtacgcgggtagcccccgcgactcgcgcgacgacccggcgtggaaccggccgtacagcggggaaccgcaacgtgggatgtacgggtggggagccgcgccgtcggtgccgatgacgcccgggcgaggacccggatccgcggcgccggtgtcgccggggcgggcggcgccggtgtcgccggggcggtccggggcggctcgggtgccgcaggccgggcagcgggggcaggagggctggggtgggcagcctcagcagcagcagtggcgtggggacgcgttcggggggcaggctccggcgggtccgggacggggcgcctatggggccggctggcctggtgcctcggatgttcccggcgttgccgacgggtccggtttctccggctcttccggctcttccggcttttccggcttttccggcgcgcctggtgaggccggcgatttcggtgcgcagaaccctgggcagcacggaggcgggcagcacagcgctgggcagcagccgggggcggctcgtggtggggcgcagatgcccggtggcggggcggggccgcgcgggccgcaagggcccggcgggccggtgcctccgcaccccggcgggcccatgtcggcgccgcaagcaggtgggccgcagcagtccggtcaggcgcagcagcagtccggtcaggcgcagcagcggttcggtgggcccgaggcgtatccggcgcggcccgaacacgaatccgggttcggtgccggacgacgggcgatgcccgaggccgggcggtccggagacgggtcgcggcccgtgtcgccggcctacggcagcgcgcgtcccgcgccggccgaggcgttcccgactcgcggcgggcgggcgccggaggggccgttcgaccttcgaccgatgccgcaggaacggaacagcccggcgccgacccggcccgcggcacagccgatccggatgacgccaccgcagccggcggtgccgccggcaacgatgtacccggacgggcccggacagacttccgggcgccccggccagactccgggacagcatggtgtccggcccgaccagggaaccgggcagcccggcatgcggcccgatcagaggcccgggcagccgggcatgcggcccgaccggggattcggacagccgggcgctcgacccgaccaggaactcggacagccgcgtaggtggcccgatcccgaggcggggcagggtccgatccggcccgggcgggtgcccgggcgtgccgatcagacgccggtcacgccggggcacggtcaggttccgggggcgccgggctacggtcgtgagaatcgtggctgggccgccgaccagccggtttccggggtcgcgtcggcaccggtctccggaatcgccgccccgcccgtttccgggatcgcgcccgtgtcgggggtcgcggccacgcccccacccgggatcgcgccggtgtccgggatcgccgccacgcccccacccgggatcgcgccggtgtccgggatcgccgccacgcccgcacccgggatcgcgccggtgtccgggatcgcttccgcgccggtgtccgggatggcgtccggcgggcagtggccggtggacgacgacgagcgcaaccggctcatggatacgcagcgaatcgacttcggggatcatggggtgcgcaagccggtccccgcgccggaatccttcgccgggtcgcagccggtggccgtgccggaaccgatcaccgcgcccgatccggtggctgtgcagccgccggtgacgcagccaccggtcgaggcgccgcgcggtgcctcgcagccggtggccgtgcccgagcccgcggcgacggagccgcgggggctgggctggctgttgtcgatgagcgggctcggtgccgagatgccggtcccggagacctcaccgctggccgcgcccgaagagaccgtggtcgtggagagcctgcccccgaccggctggttcgcgccgtccgtcgacgacgaggaaccggccgtacccgaggcacccgacagcgagacgccgtccagcgctcccggcgcacggtgggaaggcggggcagcgagcgctgaacgggatgctcagccggcgggcgagctggagatccgcgtgctcgaccttcaggtcgacggcgtggtggacagcggcgtggccgatgccgaggcgacccaggcacgtccggccggggaggacgccgggcattccggcgcggcgtgggacctgaccgggtcgggacgggccgaggatctcgcgggtctggctgcgcgcgacgctgaccggggaatgcttccgcgggcgggagccgggcggcatgagcggcccggattcgatgagccggacgagtccggggcgggcacggaggtcggggagtacgccgaggacgtacggccgggacggcatggccgggtggaggccgagcctccggtgccggtcgtcaccgggatctcgacggagacttcgccgcccacgatcgatccgatggtggccgaactcgccgaggacaccgcgcatcggacgcctgccggaatcgccggagacgaggtttcccctgcggccgcgggaatcgtcggcgacgacgttgctacgacgaccaccggaatcttgggggacgacgtcgctgcgacgaccacggaaacggtcacggacgacgtcgctgcgacgacctccggaattgcggcggaaggtgcccgagagacggacgccggattcggcggggcggacgttccggaggtgagcggcggattcggcgggacggaggttccggagacgaccgtcgggtccttcgtggacgaggtgtctcccgcggcggtcgggtccgcggaggatgccgctccgttgggcccggccgagccggttgcggaggaagatctgtccacggtcgccgagtcggttgccgaggaggttttccgcaccgcggatgagccgatcgaggagaccgccggggtcaccgcggtcgagccggtcgtgcaggaagaatccggtgctccggtcgcggccgctgaacccggggtggacggcggttcggtgatcgccgatgaagacttcgatgtggccgccggaagcgccgcgcttgccgacgacgtcgagggagagcgggcgggcggcgatgcgacgaccgccgcgccggcggatgtcatcgctgagccggaggccatcgccggaccggatgccatccctgcgccggaggccggcgccgaggcggacgttgtcacggatgcggaatccggtggggacccgggttccctcagggagacggatgccgctgcggatgcggtcgtcacgcacgccggtgtccttgccggtgccgaggtcgtcggggacaccggcggccgcgccgagtccggtgcggacgggaatgttgtcgcagagtcccctggtgacccggtggggccggctacggcagggctccccttgtcgggggtgccggtgtggcctcccctttcggtggcaagcgtcatcgccagtgccgttgcggccggcacccgctcggccggtgaggatgacaacgaggctgacccggtgggtacggcccacggcgcggccccggcagtcatcgctgaaagcgacgctggctccgcggcaaccgctgaaggcgacaccggctccgcggccaccactgaaggcaacgctgacgcagcgggcaccgctgaaagcgacacgggctccgcgggcaccgctgaaagcgacgctgacgcagcgggcaccactgaaggcgacgctggctcggcggattcggatgcgggtgatgccgattccgccggcgaggttgcggcgctgggcgccggggtgctcggcggggaggtgagggacggcggcgcctcgggcgacgtggcgagtgctggtgcgggaccggcgtccggggacgcccacgacacgtccgaaccggggtcgaccgccgcgcaccaccacggcgggaccgggccggccttcgcgctcgccgacgacaccacgcccgaggcgtccgccgccgtctccaccatcgtggcggagaccgccgccgatgggacggacagcgagtccgcaccgggcgggccggaaacgggcgcggagacggctgagatcgtcaccccggcgcccgcgggcccggaccctgccccggtcgacaccgagggcgttccggacgctgaggacgctctcccggcggatgctcacacggggcacgccgatggtggaaccgtcggcagttctgagcgtgccgcggcggctgacgaccgtaccggcaaatcggcggacctcgcgaccggcgaccgtgccgaagaggcgggtccggctccggaggaggaccgcaccacagaagcggatcccgagccgcgggaggaccgtgccgtagaaggggatcccgagccgcgggaggaccgtgccgtagaagcggatcctgcgccggaggacatccgcgagaaggcggcggatgccgcgtcgtcgcgggagagtcccgcggcagcggcggatccggcgccggtgaccggccggaccgaagaggcggacgaggcgccgatccggcagcggcgggagcagcgggccccggctgaccggcgccgcgccgatccggaggagatcctggccgcctatccgtggatgttcgatccgcggacgctgcgcgagcaggtcgacgagccggaccggctgtgggatctcagtgaccggctgaccgaccggctggagttcgccgagcgggacaacgtccgggccgggctgctcagcctgcgggccgtcgtggggcgggtgctgggtgagctggacgacgctctcgcggacgggcgggccgggctgcggcatgcggaggcgagcggggaggcgcggaccgtcgcggtggcgcgggcccggctggcgcacgtgctgcagtggcggggtgagttcgccgaggcggaccggctgtatgcggaggccgactcggcggagctgccggcccgggtgcgggccgagattcgggagctggccgggcggtcggcgttcgagcagggccggttcctggaggcggtgaaccacttcgagcgggccctggacctgtgccgggacagtgatgccgagctcgtcgagcgggtcgaggtggccctcgacgtgatggcgcgccggtccggggacggctggggaccgtatccgcgcagccgggagcagctgctgaacctgccgccggcgccgacgccgctgcgcgacgacggcaccgggctgtgggggtacgcggcggcggtggagccgcggtacgcgcaggcgcagccgttcgccgagggggtggcgtgggtgcgccgcccggactcgccggcctgggagctgatcgacgcgtccggtgcggtgctgatcggcgccgactcgggctaccgggacgccgggaagttcgccgaggggctggcctgggtgagccgggaggccgagggcggctgggtcgccatcgaccgcgggaaccggctgatcgtgccgggcgggttcgaggaggcgcggccgttccggcgcgggctcgccctcatccggcgcggcggctggggtgccgtggacaagcacggacggatcgtggtgcagccgaagtaccggcagttcagcacggtgctcagcgcgggcgggccgatcgacgggttcagcgacgagggtttcgcggtggtggacgcgggcaccggcgccggggtggtggaccgcaccgggcagccggtgctgccgccggtgcacagggccgtggtgctgcacccgtcggcgttcctgatcgccgacgaggcggggcgctggggcgcgctggatcggcagggccggccgctggtggagacccgccacaccgagcgtgccgacgcggtcgccgaggtgctcaggctcaagccggacagcaggccggttctctagttactcgataggcttcgaggtatggagttccgtcatctcggccgttccggcctgctggtcagtgagatcgcctacggcaactggatcacccacgggtcccaggtggaggaggaggccgcgctcgcctgcgtgcgcgcggccctcgaatcggggatcaccacgttcgacaccgccgacgtgtacgccggcacccgggccgaggaggtactgggccgggcgctgaaggacgagcgccgggacggcctggagatcctcaccaaggtgtactggcggaccgggccgggcgcgaacgacagcggcctgtcccgcaagcacatcatggcgtcgatcgacgggtcgctgcgccggctcggcaccgaccacgtcgacgtctaccaggcccaccggtacgaccacaacacgccgctggaggagaccatggaggcgttcgccgacgtggtgcactccgggaaggcgcactacatcggcgtctccgagtgggacgcgtcgcagatccgcgcggccaaggcgctcgccgacgacctgcggatccggctcgtctccagccagccgcagtattcgctgctgtggcgggtgatcgaggccgaggtggtgccggcctcgcaggagctggggctgggccagatcgtctggtcgccgctggcgcagggcgtgctgaccggcaagtacaagccgggacagcagccgccggccggctcgcgggccaccgacgagaagtccggcgccggtttcatcgcccgctggctgcaggacgacgtgctgaccgcggtggcccggctccagccgctcgccgacgaggccggcctgaccctgggtcagctcgccatcgcctgggtgctgcacaacccgaacgtgtccgcggcgatcatcggcgcgtcccggccggagcaggtgcgggacaacgtgaaggcgtccggcgtgaagctcgacgacggcctgctcaaggcgatcgacgacatcgtggaaccggtggtgacccgggacccggcgctcacgaccagccccgcgaagcggccgtgagcgccgtgacccgctaggtccagaaccgcatcaggtcgtacccgtcgctgaccagcaacgggttcagccccaggtggtcggcgatccggtagaccacgtcgtagaagtatccgccgagcgaggtctgccagagcgccacgaacagcagcaggaaaccgaagggcgcgaacgtgtcccaggcccgccggtacgccgggctcagccagggacgcaggatgctgcccccgtccaggcccggcaccggcaggacgttcagcacgctcgcggtgatctgcaggaacgcgaccagcgacagcgcctgccagaacgcgatgtgcccgtcgaacaccgagtccggacccagacccatcaggaacggcagggccgccaccagcgcgagcaacacgttggtggccggcccggccgcactgatcagcgaatccttggcccggctgttgatgtatcggtggtcgacccagaccgcgccgccgggcaggccgatgccgccgaggatcaccacgatcaccggcagcacgatggacagcaccggatgcgtgtacttcaacgggttgagccgcaggtagccgcgctcggccacggtcaggtcgccggagaagtacgccgcgaccgcgtgcgcgtactcgtgcaggcagagcgagaccacccagcccgagacgacgaacaggaacgcgtcgaacccgacgttgccgaagcccgtccagatcagcacgccgctcaccgcgaagatcgcgacgatgccgacgaagatcgggctcgggacgaacgcgttccgcggcgtgcgcgtgtacaccggttcgtaggtcacgtcactccgccggctgcaggctcatctgataatcgacccggtcgtcctcgaccagggtgaccgtgccgaccccgccggcctgcaactgccgccactcctggccgatccaggactcggcgtcggcctgactgctgaacgtctcggccggaccgtcgaccggtttgccgtcgacgtcttcgtaccgccaactccacggcattgagccgccccctcacgtcgtacgtcggtggccttccaccctacggcttgtgcgtgtgcggtccggctctaaggtacggggcatgtccgaagatcggtggagcagcgtcctggtgctcggcggtatccgctccggtaaatccgcgttcgccgaatcgctggtggcggacgcgccggcggtgcgatacgtggcgaccgcggtcggcggcgaggacgacccggagtggctggcccggatcgaggagcatcagcggcggcgcccgcagtcctggtcgaccgaggagaccggggccgacccggcccggctcaccgagctgctgaccagcgcaccggccggtgacacgctgctcgtcgacgatctgggcggctgggtggccgcggtgctcgacccggcccgccagcccaacgacgacgaggcggacgtggcggcgctggccgacgcggtgcgcgcctgcgcggcccggctggtgctggtgagtcccgaggtgggcctgtcgctggtgccggtcaccccggtggggcgcgcgttcgccgacgcgctcggcacgaccaaccaggcgctggccacggcgtgcgacggcgtcgtgctcgtggtcgccgggcagccggcctggatcaagcgggtcaccgcgcccgcggtgaccaccccggtcacccaggcgccggtcacgcaggcgccggccgcgctggtcaccgcgccggcgacgcccgcgccgccgccaccgccaccggtcgtggtcaccccgcaggggccgcccacgccggacgccgacgaggccaccgtcgtgctgccggcctagctagctagggctcggccggatcgacctgcccggcgccggcctgggccggctcagcgaggcggtcgagttcgccgccgccacccaggacaccaccacgccgcgcccgtggacgtcggtgcgcctgctggtgatctccggagcacacgagggcggggccgcggccggcgccgacccggccgacaccgaacgccgggtggccgagaccgagcagggcggcgggctgctcggccggctcgccgggcaggccggggcggacctcgcggtgatccgggtcgcggactccggtgcgatggaggacggcccggtcgccgacgagcagtcggtcgaggccgccatccgccaggggtggcagctggccgacgacgcggtcgacgccgggcgggacgcggtgctgctcgccgggctcggcgtgggcctggaggcggtcgcgaccgcggtgctcgccgcggccaccggcgccgaggcggccgccaccctcccccgggtgctgcagcccggcgggcgcctcgacgatcacgcgtggatggtgcgttgcgccgcgatccgcgacgcgctgcaccggatccggcaggagccgcggggcgccgtcgacatcctgcgccagctcggcggcctcgacctggcggtcgccaccggtgtgctgctcggcgcgtccgcccggcggctgccggtgctcatcgacggcccgctcgggatcgccgccgggctggtcgcccgggatctcgccgggcagacccggcactggtgcctgctgcccgaggcgggcaccctcgccctggtcaggcagggcgccgacgtgctcgggctgaccccggtgctggagctcgggctggacctgggcgagggcgccaacgcgctggccgcgctgccactgctgcgcggcgtgctggggctggcagcggcgctgccggtgcaccccggtctgctcgccgggcacgaggacgccgggctcgccgacgcctacgcggccagcctcggcgacagcgacgcgaccgcggatgccgccctggacgtgctggacgacggcccgaccagcttcggcaacccggcgcccagccgctcgtgatcccgggcgccgggcggcgcctgatcgacggggtgcggctcgcggtcaccacgctgaccgtgctgccggtgcgcggcgggcgggtcgaccggcccaccgccggcgtggcgatgggtatcgcccccgtggtcggcgcgctgctcggtctggtgctcgccggactcggcgggggtctgcgggcgctcggcgccccggcgctggtcgcggccggggtcacggtcgccgcggggggcctgttcacccggggcctgcacctggacggcctggcggacaccgtggacgcgctgggttcctaccgctccggcccggccgccctggagatcatgaagaagccggacatcgggccgttcggggtggcggccgtcgccgccaccctgctgatccaggccgccgcgatcagcgccctgtcctggtggccgatcgtgatcgcctggaccaccggccgtctcgccatcacggtggcctgccgccgcggcgtcccctcggcccgccccggcggcctgggcgccatggtcgccggcaccctgcccacgccggccgtcctgggggccgccgcggtcgttctggccgccgcggtgcccgccgtccatcaccgcccctggcagggacccctggcgtgcgcggtcgcgctgatcgcggtgctggccctgctccgccactgcacccgccgactcggtggcatcaccggcgacgtgctgggtgcgtgcgcggagctggccaccacgctcacgctgatcacgctgaccctcggctgaaagccgacggcgcggtccgccacccgcgcccgcgccgcgcgcgatcgccccgcggcgcccgatcgccccacggcgcccgatcaccccgcagcgcccgatcgccccacggcgcccgatcaccccgcagcgcccgatcgccccacggcgcccgatcaccccacggcgcccgatcaccccacggcgcccgatcaccccacggcgcggcccgcaccccactgccggcgccggccggcagggccgcgggggcggtgccggttgagcgcggcgggcggcctggcggcgtacaccgcaaagggtgaaaagaggcccggacgccggcggcgccgggcggtccgcggtggccgcggcgtcgcgggtcagcggaccgaaggcgtcacgaacgggggtttgaccaggcgcgccccggtccggcggccacggatgtcgatctcgacggtggcgccgtcgggcaggtccggagcggtgtcgatcagggcgagggcgatcccgatcttcttcgtcggggagaacgtgccgctggtggtctcgccgatcggggtgtcaccggcgaagaccggcatgtggccgcgcgggatgccgcgaccggtcagctccaggccgcgcagggtgcgacgcgggccggccgccttctcggcgagcagggcgtcgcggccccagaaggccggtttggaccagccgaccgcccagccggtccgggcctggaccggtgtgatgtccagggagagctcctgaccgtgcagcgggtagcccatctcggtgcgcagcgtgtcgcgggcgccgagcccgcacgggcggaccccggcggcgatcagcgcgtcccacaccgtgaaggccgtgtcccacgggacgaccagttcgtagccgtgctcgccggtgtacccggtgcggcagacgaccagcggcgcgccggccagggtggcgccggtgaacgacatgtactcgtggccggcgggcagcccgagtttcgccacgacgtcggccgaggccgggccctgaaccgcgaggatcgcgaagtcacggtgctgaccggtgaccgtgacgccgggcggggcggcctcggccaggcggcggaccacctcggcggtgttcgccgcgttcgggatcaggaagacgtcgtccggaccgtagaggtaggcgatcaggtcgtcgacgacgccgccggaggggtcgcagcagagcgtgtactgcgcccggccgggggcgatccggtgcaggtcgttggtcaggcacgagttgacgaactcggcggcaccggggcccagcacgcgggccttgccgaggtgcgacacgtcgaagaccccggccgcctcgcggactgcggcgtgctccttgaggacaccgccgcccgcgtactccagcggcatctcccagccgccgaacggcgcgagtttcgcgcccagcgcgacgtggcgttcgtgcagcggagagcggaagaactcggcagacatgagactcaacttaccggtgaccttgggtctggttagagtcgcggggaataccaagtgtttcccaccagccgggagcaccgcccgcccggcggcccggccccgacgtcgtggagtgcccgagtgacccagcccaccctcagcctggtcgacagcgacccggccgaattgacggtcgatgccatcgtcatcggcctgcacagccagcccgaccaggacggcgccctgctcccggcgtccggcgcggagagcatcgccgcggcgttcgacggccggctgaccgcgacgctcgccctgctcggcgcgaccggcgcgccgggtgaggtgaccaagctggccaccctcggcacgctagctagctagccgcggcgccggcgcggcggtccgcgcgctggccggcagcacccgggtcgcgctggccctgccggtgcccgacgacgccgacgccccggcggtgctgcgcgccaccctggagggtgcgctgctgggtggctaccggttcgccggctacaagaccaagccgcagaagggccaccgggagccggtcgccgagctgcaggtgcacgtgccggacgcggccgacgaggcggccaccgccgagctgacccgggccgcggtggtcggccgcgcggtccggctggcccgcgactgggtgaacatgccgccgaacgaactgcgcccggcgggcttcgccgaccgcatcgcggccgaggccaccaaggccgggctggacgtcgaggtgctcgacttcgaccagctcaaggccggtgggtacggcggcatcgtggcggtcggccagggttcggaggcgccgccacggctggtcaaactgacgtacgcgccggagggtgtcgccgagccgaagcgggtggcgctggtcggcaagggcatcaccttcgacaccggcggggtcagcatcaagccggcggccggcatgtgggagatgaagtcggacatggccggcgccgccgcggtggccgccgccatgctcgcggtcgcggcactcaagccgggcgtggcggtctccggctacctggcgatcgcggagaacatgccgtccgggtcggcgtaccgcccgggtgacgtgatcaccatgttcaacggcaagcgggtcgaggtgttcaacaccgacgccgagggccgcatggtgctcggcgacgcgatcgcccgggcctgcgcggacggcaccgactacgtgttcgaggcgtcgacgctgaccggcggccaggtgatctccctgggcaagcggatctccggcctgatgggctcggccgaggcgatcgcgctggtccaggcggccggtgacgcggtcggcgagccggcctggccgatgccgctgccggacgacgtgcgcaagggcatggagtcggagatcgccgacatctgccagaccaacgccaacctggaccgggccgggcacatgctgcagggcggcgtgttcctgcgcgagttcgtcgagccgggtgtggagtgggcgcacatcgacatcgccgggccgggttaccacgccggtgagcccaccggttactggaccaagggcggcaccggggtcccgatccgcaccctgctgcgggtcgtcgagacgctgtgagaaacggcgtgccgcccggcctaatcgggctgggcggcacgcttgcgccgggcgttgaaatcgcgcatgcgctgcggatagccgagcagccggacatcgtagatcggcagcgagagccgaagggcgaaacggcgcgcgacctccggtgacccgatgcgccgacgagtccattcgccgtcgtgtgcgacaagcaacacggtggtctcggtcactgtggtgcgcggctcgacgaacgcctcgacgccacggcgggagcggacgaactgcgtgaggtggtcgagatcggcctgatcgaccgggcgtccgccgggcccggtggaccggggacgacgccgaaaccagcccactgctcctcctcacgctgaatgccgcaagggtacgacgagccgacgtgtcttggggcacctggctgcattgagcgggtctccaagtgacaagatgtccgagacgggactgtgaccgtttccattgtgtgacccacatggcgacgactcgactacgggagtcaacgtgagccagccgaacggcggaaccttcgacatcgtcattctcggcgcgggcagcggcgggtacgcggccgcgctgcgcgccgccgagctcgacctctccgtagcgctgatcgacaaggccgaggtcggcggcacctgcctgcaccgcggctgcatccccaccaaggcgctgctgcacgccgcggagatcgccgaccagacccgggagagcgagcagttcggcgtcaaggccgacctggtcgggatcgacatggccggggtcaacgcgtacaaggacggcgtcgtcggccgcctctacaagggcctgcagggcctgctgggccacaacaagaacatcaccctggtgcagggcgccggccggctggtcggcaaggacaccgtcgaggtggacgggcagcgctacaccggccgcaacgtcatcctggccaccggctcctactcgcgcagcctgcccggcctggacgtcgacggcacccgggtgatcaccagcgagcacgcgctgaaactggaccgggtcccggcctcggcgatcgtgctgggcggcggcgtgatcggcgtcgagttcgccagcgtgtggaagtcgttcggcgccgacgtgaccatcatcgaggccctcccccgcctggtcgccgcggaggacgaggagatctcgaagaccgtcgagcgcgccttccgcaagcggaagatcaacttcaaggtcggcaagccgttcgagaaggtcgagaagaccgcggacggcgtcaaggtcaccatcgccggcggcgagaccctggaggccgaggttctgctggtcgcggtcggccgcggcccgaccacggcgaacctgggctacgaggagcagggcatcaccctggaccgcggcttcgtgatcaccaacgagcggctgcacaccggggtcggcaacatctacgccgtcggcgacatcgtgcccggcctgcagctcgcgcaccgcggcttccagcagggcatcttcgtggccgaggagatcgccggcaagaacccggcggtcatcgacgaggccggcatcccgcgggtcacctactccgacccggaggtcgcgtccgtcggcctgaccgaggccaaggccaaggagaagtacggcgcggacaaggtcacgtcgtacaactacaacctgggcggcaacggcaagagccagatcctcaagaccgcgggcttcgtcaagctggtccgggtcgaggacggcccggtcgtcggcgtccacatggtcggcgcccggatgggcgagctggtcggcgaagctcagctgatctacaactgggaggccttcccggaggaggtcgcccagctcgtacacgcccacccgacgcagaacgaggcgctgggcgaggccttcctcgcgctcgcgggcaagcccctgcacgcgcacagctgatttcatcgcttcgagaagcgttaaaggagtttggggaaaaatgccgacatcggtaaccatgccgcggctgggcgagagtgtcaccgagggcaccgtcacgcgctggctcaagcaggagggtgagcgggtcgaggtcgacgagccgctgctcgaggtgtccaccgacaaggtcgacaccgagatcccgtcgcccgccgcgggggtgctgacccggatcgtggtcggcgaggacgagaccgcggaggtcggcagcgagctggcggtcatcgccggggagggtgaggacgccggtgcggccgcccccgccccgcagcagcaggccgaggccgagccggagccggccgcgctgaccaccccgtcgaccgagaagccggtcgaggaggaggcgcccgcgccgcagaccgccgccgggtccgccgagggcaccgaggtgaagatgccggcgctcggcgagagcgtcaccgagggcaccgtcacccgctggctcaagcaggtcggcgagaccgtcgaggtggacgagccgctgctcgaggtctccaccgacaaggtggacaccgagatcccgtcgccggtggccggcaccctgctggagatccgcgttccggaggacgagaccgccgaggtcggcggggtgctcgcgatcgtcgggtcggcgtcgtccgcgcccgccgccgcgcccgctccccgcagcccgccccgcggcagccggaggccgagtcgaagccggagccgaagccggagccgaaggcggagccggtcggcgagtcctacgcgacgccggccctagctagctagaaggcggagccgagcccgctgcgcggccgcaccgagaagctgacccgcatccgggccaccatcgcccggcgcatggtggagtcgctgcaggtctcggcgcagctcaccacggtcgtcgaggtggacgtcaccaagatcgccacgctgcggaacaaggcgaaggccgacttccaggccaagcacggcgtcaagctgaccttcctgccgttcttcgccctggccacggtcgaggcgctgcagcagcacccggtggtcaactcgtcgatcgacgtcgaggcgggcacggtcacctaccacggtgccgagcacctgggcatcgcggtggacgcgccgaagggcctggtcgtcccggtgatcaaggacgccggcgacctgaacctggccggcctggccaagcggatcgccgacctggccgaccgcacccgcaacaacaagatcgggccggacgagatcggcggcggtaccttcacgctgaccaacaccggcagccggggcgcgctgttcgacaccccgatcatcaaccagccgcaggtcggcatcctcggcctcggcgccgtggtgaagcggccggtgatcgtgaacgacccgaacctcggcgagatcatcgcgccgcggtcgatggtctacctggcgctcagctacgaccaccggatcgtggacggcgcggacgccgcccgcttcctggtcacgctcaaggagcgtctggaggccggccacttcgagccggacctgggcctgtagaggtaggacgtaagggccgggggtacacacgtacccccggctctcatgttttgaatcggttgatcttcgggaaagagaaagagcatgcggatcgtcatggccggcgcctccggctttctcggtgcccggctcgccgcccggttgcggcagagcggccacgacatcacccggctggtccggaaacccgtcccgggcgccgggccggaggtcgccgtctgggcgccgtcgcagggccggctcgacctgtcggtgctcgccggcgcggacgcggtggtcaacctggccggcgccaacatcggggcccgccggtggaccgcgcagtacaagaacgtgctgcgctccagccggctggacaccaccgacacgatcgcccggacgatcgccaagctgcccgccggtgaccgcccgcggaccctgctgcagtcctcggcggtcggctggtacggcgacaccggcgaccgcgaggtcaccgaggaggcgccggccggcaccacgttcctggccgacgtctgccgggtctgggaggccgccgcccatccggccgaggacgccggctcgcgggtggtgctgttgcgcaccgccccggtgctggaccggcagggatcgctgctgaaaccgctgctcccggcgttcaagctgggcgccggcgcgcggatcggcgggggccggcagtggatgtcgtggatcgcgctggccgactggctgggcgccgccgagttcctgctggagcgcgaggacgtggccggtccggtcaacctggtctccgccgagcagtgcaccaacctggagttcacccgggcgctcgcccgccggctgcaccgcccggcgctgctgaccgtgcccggcccggtgctcgacctggcgctcggcgagctggccggggaggcacagcgaagccagcgggcgattcccggcgttctgcgcggtgcgggattctcctggatgtacccggacatcgagtccgccttggccgccgcgctggatccggaaccggcgaaggccccctgatctccagggcccgctgctaacctgcgcgtgatgtccgtgaccgcccccgccccagccgcgtccgccgatcctccctccgagcccgccgccgcatcgggccgcgaggcgcgcgaatggcctgttcacctggccttcgccgtcgtcgcgctgtccttcgcggtctacgtgacgtgcggcctctgggcggatccgtacacccatgtgctcgccgacaacgtcggcgaccaggccttcttcgaatggctgatggggtacgggtactacaccgtcacgcacggctcggaccccttcttcaccagcctgctgaacgcccccctcggggtgaacctggcggccaacacctcgatcacggtgtacacggtgctgatgacgccgctgacccacctggccgggccgcaggtcagcttcgtgaccgtgctgacgctgaacctggccggctccgccttcgcgtggtatctgttcctgcgccgctggctggtcggcagcgccggggcggccgccgtggccgggctgttctgcggcttcgccccggggttcatctcgcacgccaacggccatctgaactggaccgccggctgggtcgccccggtcgtcatctggcaggtgctgaaactgcgtgagccgggccgctggctacgcaacgggatcatcctcggcgtgctgatggcggtcggtttctcgatcgccgccgagggcctgttctacaccgcgctggcctgcgccgtgttcctggtgatgtggtcgctgagccggtcggtccgcaccgaggcgcgggacgccttcctgaccgtgttccgcgcgctctgcgtgaccgggctggtcgccggcgcgctgctggcctacccgctgtacatgcacttcgccgggccgcagacgttcaacggcaccggcttcaaccagcggtacttcgtcgaggacgccgcgtcctacctgtccttcccgaaccgctccgtcgccggctggctgggctggcacgccgacctggcgccgaaccggaccgaggagacgtcgttcttcggcgtgcccctggtcctgctgatcctggtctcgttcgtggtgctgtggcgccgggcggacgccggccggcgggccacactgcgcgcggtcggcgcggtcggcgtggtgttcttcgtcctctccctcgggccccggttcaacctgcagaagcacgagtacccggacttcccgctgccgtacgcggcgctggtgcacctgccgctgttcaactcggcgctgccgatccggttcgcactggtcgtggtcggggtcttcggcatcctgctggcgctgatcctggaccagctgatcaccaggaagatcccgtccggctcgctgctgcacaccgcactggcctcggccgcggtgatcggtctgctgccgatcgtcccgctgccggtgcggatccagttccggacaccggagccggcgttcatcgcgcagggtctctggaagaactacgtgcccgagggcgggacgctctccgccctgccgttcggggccaacgtcaccgcggacgcccagcgctggcaggcgtacacgatggctcgcggcgggcggcagttccggatcccggacggctacttcctcggcccgcagaccaccggcgacaccggccggaagcagccgggccggatcggcgcaccgccgatggccaccgactggctgttcctgcgcgccgcctggtacggctacatcaccacgctgaccaacggggaccgcgcccaggcccgcgccgacttcgagtactgggggctggacgcggtgttcctgccgtccaccatcaccggctcggaccaccagacgctgaaccggaccgcggtcgagagcaccgcccgggacctgctcggtgagcccgaggtggtgggtgacgtcctggtgtggcgcatccgtcgcggagtcgaccccgtcgaccggtaggtacccgccggtacggggatacgctggccgtcgtgacaacctccgtactcaccgttctgcgccccggcctggtcgactaccgcgacgcgtgggacgagcagaagcgtctgcacgaggccgtggccgacggcgcccagccggacaccatcctgctgctggagcaccccagcgtcttcaccgccggtaaacgcaccgagccggcggaccggccgtgggacggcaccccggtggtcgacgtcgaccgcggcggcaagatcacctggcacggtccgggccagctggtcggctacccgatcctgcgcctgcccgacccggtcgacgtggtcgcctacgtgcgccgggtcgagcagctgctgatcgacgtgtgcgccgagttcggcgtcgccaccgaacgggtcgagggccgcagcggcgcctgggtgcgggccaccgacggcggcctcgaccgcaagatcgcgcagatcgggatccgggtggcgcgcggcgtcaccctgcacggcttcgccctcaactgtgactgcgacctggcgaatttcgagcggttcgtgccgtgcgggatccgggacgccggggtgacctcgctcagcgccgaactcggccggccggtgccggtcgccgaggtgatgccggtcgtcgagcggcacctggcgacgctcttctagccgacccgccagacgctgcgggcgctgcccgtcgtcgggcaggccagaaacggcccggcgacggtgcagccgaacgggagcacaccggccagctcaccgtgcaggcggccggtgcgcaggtcggtcacccgggtgccgccggtcaccgcgcgcagcatcaggccaccggtggccacaccgcggcccagctcggtgacgacccggccggtcgccggatccagccgggcgacccggccgcccgccgacgtggcgagatcgtcagcggtgtacgacgcccactccgcgccgctccagcgcacctcgccggtggccgtatcgagcgcggtggtgccgccgctgccggtgacgcagagcaggtggccgcaactcaccgcggacaccgggaacggccgcggcaccgaggtgagccaggtgaggctcccgtccgtgatgctcagcgcggccacggcggacggacccagcacgtacgcgtgatcaccggcgacggccaccgacggctggtacggccgcgtcccgtcgatgatcagctgctcctccggcacgatcacgccgttcagatcccggctcgtggccagccgcccgtcggctgtcgaccgcatctccacctggccgccgtcgttcagcatgatcagccggaagccggccggatccagcgcggcagcggccgcgtacccgggccgcgtccaccgggtccggcccgacgccagatccaccagccgcagccgggcctctccggtgtcgctgtcgaaatagctgaccagtgcccggtcgccgaacggcgcgacggtgctgccgtccggcgggcgccagcggaccctgccggtcgccacgtcgagcaccgtcacggtgccctcggcatcggcgatcaggaccggaccggccaccgtcagccgaagttctccgccgtccagcgggacccggacctgccagtccgggccgccggccaccagcgggcgcgccacgatcaccgcgcccgcgcccgggccggccgcccggtgcgccgcgtacagcgcccggtcggtgcacacactgtccagcgtcgcctggccgccggtcgaggcgatcatcgggaacggcggcgggagcgccggcacggccgcggcaccgaccggcagcagcacggcggccgcggccagcagcttccaccaccgggtcccggacgggcgacgaaccggggccggggccggcgcggcatcgaggtcgatcagcaccggcccaagctaaccctagggagccacccggtgcgggtcgcgcgggaaagccgccacctcgcgcacgttggccgccccggtcagccgcgcgaccagccgctccaggccgatcgcccagccaccgtgcgggggcatcccgtaccggaaagcctccagatagcccgcataggccgcgagtggctcaccggccgcgcgcagcgcggcgacacagtcggcgtgccgatgcagccgctggccgcccgtgacgatctccaaacctcggaagagcaggtcaaagccgttggagtacgtcgtgtcggccgggtcgggatgggtgtagaacggccgtttacgcatcggatagccggtcacgtagacgaactccgacccgtgctcacgccgcgcccactcgcccagcgcccgctcgtgcgccggcgccaggtcgggctcgccggccggggcgccggcgatccgcaacgcctcggtgaagtgcaccgccgggatctccgccggcacctccggggtcaccaccccggtccgggccgtcacctcgccgagcatcccgccgagcgtgcgggtcagggcggccatcacgtcccggtggtcggcgacgaaccccatctcggcgtcgagcgacgtgtactgggtcaggtgccgggcggtgtcactgttctccgcgcggaacaccgggccgacctcgaatacccgttccaggacgccgaccatcatctgcttgtagaactgcggcgactgcgccaggaacgcgggcctgccgaaatagtccagctggaagacgttcgcgccggactcggtggccgactcgacgatcttcggcgtgtggatctcgacgaaccgctgcgcctccagcgccgcgcggaaaccggcggtcgcggcggcggccacccggagcgcggtacggcgcgccgggtgccgcagcgcgaccgcggcgtggtccagctgcgcgggcaggcccgcggtgagcgcaggccggtgcagatcgaacggcagcggtacgtccacagcggagtgcacccggatcgccggagcggtgagttcgacgccgcccggcgcctgctcgttcggggtgaccacggcgacgatcgcgacgacggtctcctcgcgcaggtcaccggggtcgtcgacgaccacctgggccagcccggcggcgtcccggacgatcaggaaagtgaccgacttcagccggcggatccggtggacccagccctcgaccagcaccttctcgtgcgggtgggcggccagttcggtggagaggatgcgttgcacggcggtcgacctcctcaggatgctgcaacgcggccccggggaggtgcgggcgagcgggatcctcgcggtaccaccacaccttcgcgccccgccgatcgccggggcgcctcttgcactgctcggctccggggtgtcttcgcgctccggcgcacgggccaccgtcacagctgcgggtggctctctcggccggcgtttgcggagcgttactcggtcccatcactgccgtagccgggacgttaacgccccacgaccggcgcgtgcatccgaatttcgtttcggaggtgacggcggtcacaggtcaggtcacgtgagcctcgtcgcccctgcgcctcgaccggtcgtctccggcgtatcttcggggttgtgactattgctcccgagggccgccgcatgctgcgcatcgaggcgcgcaacgccgagactcccatcgagcggaagccgccgtggatcaaagtcaaagcgaaaatgggccccgagtacacgcagatgcgtggcctcgtgcagaaagagggcctgcacacggtctgccaggaagccggctgccccaacatctacgaatgctgggaagaccgtgaggccaccttcctgatcggcggcgaccagtgcacccggcgctgcgacttctgccagatcgacaccggcaagccggccgagttcgacgccgacgagccgcgccgcgtcggtgagtccgtcgccaccatgggcctgcgctatgccaccgtcaccggcgtcgcccgcgacgacctgcccgacggcggtgcctggctctacgcggaaaccgtccgccagatccacgctctgcagcccggctgcggcgtcgagctgctcatccccgacttcaacgccgacccggcccagctggccgaggtgttcggcgcccagcccgaggtcctcgcgcacaacgtcgaaaccgtcccgcggatcttcaagcggatccgccccggcttccggtacgaacgctccctcgacgtgatcacccaggcccgcgcggcgaacctggtcaccaagagcaacctgatcctcggcatgggcgaggagcgggcggagatctcggccgccctccgcgacctgcacgccgcgggctgcgagctgatcaccatcacgcagtacctgcggccgaccccgcggcaccacccggtggagcgctgggtcaagccggaggagttcgtcgagctccgcgaggaggccgaggcgatcggcttcgccggggtgatgagcgggccgctggtccggtcctcctaccgggccggccgcctctaccgtcaggcgctcgacgcccgcggctgatccgtcggttttcgtccgcggcccgcgtctgctcgcgggccgcgttcggggccgcccttgtgcggcgcctccgtaggcttttcttcaccacggccgcgtctgctcggagacccgtcaacggatgaaggcccgcaacctctccaggtcatccgttgcctggaatggttgcgggccttcgccgcgttcacttcttgcccttcttgcctttcttctccttacctttgcccttctccgcgcccctgtccctggcctgcccctcacgttcccgccggaactcggcgagccgccgatccgtctccgcctcggccgccgccgcctcggggaacatcatcggatagagcaacctggcgaacagaatggcaatcggcgcaagccaagcccaccagggaatcccggagtccggcccgaacaacgcctcgacgacccgataagccatgtcgaccgcgctgtccatcaccggccccccgggggcgtgcggaacttgtcgttcatgacggctcccttagctgttggtcggcccccaatatcggagccccgccagccgtcattagccttccccggccgcgcccccgcatcccggccggcgcgagcgtttccggccggcattcgctcccacctcgcaaccgtccacaccggccccgcacccggatacccgatgcgctccaacggacagcgcgactgaccgcagcccgacgaggtacagcacgaccgaccacggcccaaccgaccgcaacgcggcaaaccgcaacgcaactgaccgcaacgcgaccgaccgcagcacaactgaccgcaacgcgaccgaccgcaacccgaccgaccgcaacgcgaccgaccgcaacccgaccgaccgcagcgcgaccgacgacaggcagcaacacggcaggcggcagcgctgcaaacggcagcgccttggtagccgccagggcatggcatgccaaaggccggcggtgacgaccggcacgcgaccggccttacgtccgccagaggggcggcggcacggcgatcagtcggccaacaggttgaggcggtgggcgacggcggcggcctcgatgcggttggtcaccgcgagtttcgcgatgatccgggagacgtggacgctcgccgtcttcggcgagatgaacaggcgctgggcgatctggccgttgctctgcccctcggcgaccagccggagcacttcccgctcgcgggcggtgagcacctcctcgagcgttccggcggctgtcgccgccgggcggaccccgagccgccgggccagcgtctccgcggcctcgaccagcggcgtcacccgcaggccgtcggcgatcgcggtgacctcggcgagtgctgtagccgccgcggtccggtcggcggcgttcgcctccgcggcccgcagcagcgcacacgccagttcgtagggctgcccgtcagcacgccaggccgcgactgccgcgccccaccgctcagcgcccccgtccagctccgccgccacctgggccgccccggccaactcggcgggatagtgccgcggcaactgctccgccgcccaccagattcgagcagccagccgcgccgcctccaccgaaagatcgtcccctggagcccccgccgtggaagccccgtttcgcaccccgtcccctgaagaagccacacttcgcgacaccgcccgggccgaagccacctcccgcgatgccgccccgaacgaaaccgcatcccccgacgccgccccgaacgaaaccgcatcccccgacaccgccccgaacgaggccacatccggcgatacggcctctatcggaaccgcgtcctgtgacaacgcccatgacgaggtcgcatcccggatcggcatccgcaaactggccgcatcccgcgatcccggttcccaagaaggcgcatcccgcagagccgccgccagcgaggccgccgatgagacagcggcacgcggagagggcgcggagcgccccgcgacgggtgaggaggcggcaccggcagaagtgatgtcgcggtcctgagaagagtcgcgggccagggcggagtctcgggccagggcaggatctcgggccacggcaggatctcgggccagggcagatttgcggacccgagcggaatcccgggccgaggaagaatccggggccgagacagaatcccgggcggaggcaggatcgcgggccggggcagggtcgtgggccggggtggcatcgcgggctgcggagaccgctcgggccgcggtggccagcagctgccaggtgtagcgcgggcggtcgagcagtgccgggtcctgcagggcgacccgggccaccgccaccgctgccggcacgtcccgttcgtggagggcggcgaggacgcgcagctcgtgcatccagagtttcttctcggccggcacgtagggcttgccgagcatgccgatggcgcggctgagcagggggccggcgccggcgtggccgcgggccaggcggagacgggcgcgcaggcggagccagggcagggccatcaggccgggtgggtcctggcgggcggcctcggccaggcgggcgtcggcctcgtcccagcggcccagggcgagcagcgcctcggcgtggttggcgagcaggtggaccccggtggtgcgggccacaccgtaccgtgcggcgtgcggaacgccctcggccgcggcggcggcggactcctggtagcggcccagctcgaacagcgcgtcggaaacgttgaccaggccgtgacacagcgcctgctcgtcgtcgagccggcgggcctgggcgagggcgccgagcagtgtgggcagaccctcctgcgccgtcacccggccggcgcagacctggcccttggtgatctccgcatacacctgggcggtggtgtcgccgagctcgtcgaccgacgcccggacctgatcccagatccgggacacctcgtcgccgtccatcccggcgaacagataggccacctcgccgagcagctccgcccgccccggctcggcaaacgccgaagccgaggccgaatcggaggccgacagcgaagcggaagccgcatcggaaacggaagtcgaatcggaaacggaagtcggagccgaggcggagggtgcagcggaagcggagacgaccgcggaagaccccgcagacgcaccggacaccgccggtgcggcaggagctgacgccacggcaggcgccgccgacgtgaccggcacggcggtgagcagccgatacgcctccttggtctcggcgaacccatcgctcttgcccatgttgcgcagcagccgggcccggcagaccagcagccgggcggcacgcagcggctcggcctcggagtccagctcggcgagcgccgcctgggtcagtttcagcgcccgggtcagctccccggagtcgatcgcgaccagcgcggtctcctccagcaggtcgaggtggcagacaccgagcaacgagccggccgcgggcacctgctcccacaactccagcacccggtcgagcaggcgggcctgctccgcgtacgcgaactgccgcccggcctcgtcggccgcgagtttcgcgctgaccagggcccgcgggtggtttccggccgcgtgccagtggtgggcggtttcggcgggggcccggcccggcgggacgaggtgcgggtcggcctcgatcgcctcggcgtaacgggcgtgcaggcggaggtgctcgccgggcagcaggtcgtcgtggaccgcctcgcggaccagggcgtggcggaactcatagccccgctccgggtcgaagacgatcaatcgggcggcgaccacgacccgcagtgccgagtcgagggtgacctcgtcgacgccggcgacccgggtgatcagctcgtggccgagccgggtgccgccgaccgcggcgacgcgcagcatccgctgggccgcctcggtcagctggtcgacccgggagagcagcaggtcacgaagggtttccgggatgtcggcgcaggccgggtcggcggtggcggcgagctgctcgatgaagaacggcacgccctgggcgcgccggtcgacggcgtcgacggtctgcggccgcggctcgccgccgagcaggtgggtgagcagctccgcggtgccgtcccggtcgagccggtggatctccaggcgttgcacgccgcggacccgctccagctcggcgacgaacgggcgcagcgggtggccgcggtgcagctcgtcggtgcggtaggtggccagcagcagcatccggggcgcgcgggcggaacggaccaggaaggcgatcaggtcccgggtggagcggtcggcccagtgcagatcctccagcaccagcagcagcgggcgctccacggcgagccgggcgaacagcgccgcgacgagctcgaagagcagcccgcgatgggtgtcaccgaactccggcgcggggccgagctcgggcagcagccgggcgaggccggactcgcgcccctccaggaccgccaccccctcgtcgcggaccagctcgcgcagggcggccgcgaacggcgcgaagggcagcccctcctcgccgagctccaggcactggccggtgagcacccggaccggctcgccggccaggctccgggtgaactcctcgaccagccgggtcttgccgaccccggcctcgccgccgagcagcacggcggccggctcgccgccgcggacccgccggaacgtgtcgcgcagcgcggccagatcggcatcccggccgaccaggatctcgctcgccgtcatcatggggtcgagcatgccacgcggatccgacagaaaatccggaccgatcgtgcgggacggggccgcggcatcggccagccggccgatcgtgccggacagggccgcggcgtcggccagccggccggtcacgccggacggggccgcggcaccctagctagctaggggcccgccggtacgcctcggcctcctgccgcagctgctcgccgcgctgccgggccagactcagattgatctcgggatacatggcggtgcgctcctcgcgtcgagtcgtcgtccttgctgacgtcgactcttcgcgcgaaggcggcggccgggcatggggacgccgccgcacttccgggccgcgcactgccttaccgggcacgcccggggtgcccgggacgccgtaaggtacctgaggctgactacactttccggctatggcaaaaccccaggagaaggtgtccttcgtcgagcgcctgaagcagatcggccaggtgttcagtttcaccgcgaaacaggacaagtggttcgtcccgctcgtcctcgcggcggtgctgatcccgatcgcgctcaccgtggtcgccgtgctcctgggctggggtgtgctgttcatcccggtcggcatcctggtcaccgtgctggccgtgctgatcgtgctgaacctgcgctcgaacaccgcgatgatgaacgtggccgagggccagcccggcgcggccgcctcgctgatggagaacatgcgcggcgactggcgggtccgtccggcggccagctcgaccacccagttcgacatggtccacgtggtgatcggccggcccggtgtgatcctgctcgccgagggccacccgcagcgggtcaaggccctgctcggccaggagaagaagcgcctgtcgaaggtgatcggcaacgcaccgctctacgactacgtgatcggctccgaggagggccagctcccggtccgcaagctgcgcaccacgatgctgaagctgccccgcaacctgaccggcaaggacgtgaacgcgctggacacccgcctgtccgcgctgatggcccggccgcagatgcccaagggcgcgatcccgaagaacatgcggccgagcaagggcgcgttccggcagcagcgtccacgctaagctcgcgatccacccggtggtccacccccgtcaccgggacgcgaactgaaaacggagacgagatgcctaccgctgggccttaccgcctgcagcgccagctgtcgagctgcgaggtcggtgacgtctggtcgggcgtcgacgcgcaggggcggccggtgacggtcgcccagctcaatgagctcgcgtcggccgacgaccgctggcgcggcgctttcgccgcggcttccgaggcgctgggccagtccgacaccgatcggctgccgatcgacggctccgaccatctcggcgagcggccctgggtcgcctgcccggagggcgagggccagggcgacgcggcggagatcttcacggtgctgggccagaagctgcgtccggtcaccgccgggccgccggtggagacgccgccgccggcctccggcgacgcggtggtcgagcagcattccgattcggtacgtcgtgagcaggatccgccgacggcgcccttcccgccggtgccgagtccattcccggccgccgccggccaccccgtgtcggcgcagccgttcgccgcccaaccggtgtcggcgcagcccatgtcggcacagcccatgtcggcgcagccgtggccggccacgcccggtccggcccagccgatgtccgcccagcccgggccggagcgtcccatcccggcgttcccggtcgccacccagccggtgtccgcgcagcccgtttccgcccagccggtctcggcgcatccggtgtccgaccaccccgtgtccggccacccggtctcggctcagcccgtctccagccacccggtctccggccatccgacgtccggactgcccgccttcagtcacccgatctccgcggtgccggtgtccgggagcggccaggcgtaccagcaaatcggtcgcccgccgcgccccgaccgcctcctgttgctgatcgtcggcctggtgtgcctgcttctcggcggcgccgccggcgccgccgtggtctccctgcagcgcgatggcaagccgcgaccggcggcgagcgacgcgccggtcacctacaccgacgctcagctgctgctgcccgccacgccgccggtcgcgccggggctgaccccggagccggacggcgagtggccgaaaagctggccgaccttcggcagcaaggccacggtcaagcgggtgaccgatctcgacggtgtcggcttcgatttcaaggtgcccgacggctggacctgcgagctcgccgagaaggccgcggccgcggtgcactaccggtgcggcgcgttccaggggccgaccctgaccgccggcggcgatctctacgtgcgcacctgcgcggcggtctgtgacgacaaggcgcgtcaagccctgcggcagcgcgaggaggcctggggtctacggtggaccagcggcacctcgctgcgctcctgggcggagaccgacaccatcgacggcaagccgcagtacgggctggtctacgtcgggttctggcgcaccaccccggaggacgtgctgaaccgcgaggtcgtgctgcggatgaccgcgccgcccgccgccaagaaggacgtgaagagagtggccgacaacatccgcgaccgcacgtacacgcagtaaaaggagcacctcgtggccagcaccctcgcggtccccggcacctatccgacgatccgtgacgcgctcgaggtggcaccggacggcgcggtgatcaccatcggtcccgggacgtaccgggagcggatcgagctgaccgggcggcggctcaccctgcgcggctccggcgaggagggcacggtcgtcgtcgacgccgccgcgctggaggggccggccctggccgtgctcagtggcgaggtgaccgtcgaggggctggacctgacctcgggggactatccggcgatcgccgtcacggccgcgcgggtcgtcgtccggaaatgtcgcctccgttcgggttatgccgccggcctgcaggccaccgacatggccacggtggaggccagtgaggtccgcgtactgaagggccagaacgggctggtcttctcggacgccggcggcacggtcgagtcctgcgaggtccgcggggtcaacgacgacggcatcatcgtgcggctgggcgccgacccggtgatccgcaacaccacggtcgccgagtgcggctatcgcggggtgtacgtctatcagtccggccgtccggtgatcgagcgctgtgacatctccggcaccggcgacgccggcatcgtgatcgccaacagcagcgccccggcgatccgggagacctgggtgcaccagaccgccggctccgggatcgtggtcggcgccggctgctccgcggtggtcgagcagtgccgggtcgagggcaccgccgagccgaaggtcgcggtcgacccgcgcgcccaggccaccgtcaccctctccgagggcggtccggcgccgcgggccgggatcaccgaggccggcgccgggcaggacgccgccgaggtcgaccggctgctcggcgagctcgacgcgatgatcggcctggccggggtgaagaacgaggtccgcgccctgatcgacgagatccaggtgaacgagtggcggcgcagcgccgggctgtcggtcggcgcggccagccaccacctgatcttcaccggcgccccgggcaccggcaagacgacggtggcccgcatctacggtcagttgctcaaggcgctcggtgtgctgcccaacgggcggttccgcgaggtgtcccggcgcgacctggtcgggcagtacatcgggcacaccgcggagaagaccacctcggtgttcgaggaggcgatgggcggcgtgctgttcatcgacgaggcgtacaccctgtcccgggccggcggggccagcgccgacttcggccaggaggcgatcgacaccctggtcaagctgatggaggaccaccgtgaccaggtggccgtgatcgtcgccgggtacacccgggagatgctcgatttcctggacgcgaactccggtctggcgtcccgcttcgccaagacgctggagttcgagaactacgggccggacgagctggtgatgatcgccacccggatcgcgcagaacgacgactacacgttcgcgcccgggctcagcgaggcgctgcacgagcacttctcacagatcgagcgggaccggaacttcggtaacgcccgcgaggcccgcaagctgctggaggggatgcgcaaggcgcagtccggccggctgcggtcgctgggccggatgcccagccgggacgacctgaccacgctggtgctcgacgatctgctgacggcgatccgctgaggactcgccgggccgcttcctgtcgggggtggcacatagaatgggctcgctacggggacggcggggaggtgtgcggtgaatccaggtgacggctactccgggcaggcgtatggcgccgctctgccgccgccgcccgcgagcgctccgccgcccacgcctagctagctaggcaggtcgggccgctgagcctcacccagatcgtggtcgccgaggtggccgtgctggccaccatcgcggcggccctgcaggggccgatcccggcgctggtcaccggcgtcgccgggctgatcctgatcatcgtcttcttcgcccggcagcagggccgctggtggctggagcaccggcagatcgcccgccaccacgcccgccggcgggccgccgctccggagaccggggccgggccggtgctggccgcgctgcgcaccatcgcccccggcctcgccgtgcgggacatgaccgcgcaggacggcgcccgcgccggggtggccaaggacgaggccggctggttcagcgtggtggctctcaccccggccgcgccggtccaccacgacgccgcgccgatcccgctggacgcgctggtcagcgtcctcgccgcgaccgagcagccgggcgtggtgctggagctggtcacgcacaccgtgccggcgcccagccccgacgtgcacgcgtcctcgccggccgtctcgtcgtatcgccagctcgtcgagtcgctcagtccggagccggtcccggctcaccgggagtccacgatcagcgtccgggtcgacgcccgggtgctggccgaggcgctgcacgaccacaccgccgatctggagaccgccgccgccctggtcgccggcctcggccgcaaggtggccaccagcctgcgccggatcgggatcgcctgccgggtgctcgacgccgacgagctgctggccgcgctggcccgctcgtgcgacgtcgaggccggttcgctggccgagggcgcacaggtcgacgaggactggacacactggagctcggcccgcctgatccaccggacgtactgggtgaagacctggcccacctcggccggcgagatcggctccctgttcgcctgggcggccaccgccccggccgcgcagaccagcgtcgccctggtgctgaacgccgcggccgacggtgaggacgtcgccgtccgcgccttcatccggctggccacccggcccgacgccgacctcggcgccctcgaccgcgtcctgctggagggcgtcaaacgcgtcggcgccgagctgcaacccctggacggcgagcacggcccggccgcctacgccacggccccgacgggaggcggagcgggatgaccgacccgaaccgggacggctcctggcgtccctatcccccacagactccggaccagcccgccgccgacgccgatgcgccggacgccgcggggcgtgagcagcagttgccaccgccacccgcgatcttcccgccgggttcggtggcccgtgcgcaggtgcgtccgccgcagggtcagctgccgccaccgccggcgcacctcccgcaggcgccgacgggtccggggcagggccagtatcagcagggtccctactctccggggtcgtattcgccgggcggggcgcagcccggcttcggtccgcatccggcgggggcagcagccccgtccgggcagttcgcgcccggccaggcggcgccggcacccctcgcacccggccaagcggcgccggcaccactcgcacccggccagcccgcgccggcaccactcgcacccggccagcccgcgccggcatcactcgcacccggccagcccgcgccggcaccactcgcacccggccagcccgcgccggcatcactcgcacccggccagcccgcgccggcaccactcgcaccgggtcaagccgtgccggcacagggactgttcgcgccggggcaggcgtttccgacatccgggctgcagggaacgtccgggtcgcagggcctgcagcagggtgcgggtgatgcgagcgggcggcggctcgccgcgccgcagctgacgtcggcgcccctggccggcccacagggccggctgccggccgcggcgcaggcggcgcagacgtgggagaacgactctccgccggacgattccccggacgaggacgacgacgcccgtaccggcccctccgggaagacgtcaccgctgcacatcggctggcacgcgatctcccgtaagacgctgcgccgggtcaccgtggccccgtccgcgggcgccggcctggtgctcggccgcgaccggcagcacgccccggtccccctgcacctgttcgcccccgaaccggtccgcatcgccctggtcggcggcgtctgggccgcccagctcctgatcttccgagccttcgccctgggcgcccgggtcgtcgtcgtcaccaccgagccccgcgcctgggccggcttcggcgaacgcgccaccggtcagtacaaccggctcaccgtccacagcagcgaccagggcgtcgccctggccggcagcgcccagatgcccacgctggccgtctacgacctgggcatgtccggcccggccaccaccccaccgttgggcccgtggcgcacccagctgaccatcctgcgccagctggaccgccccggcctggccgccctccaggatgcccagctcaccctcctgcagcgcctgggcggtgacgaggccgccatggccgcctcagccctgaagttgcgcccgcacagcagccagttcctccagttcatggccgacgacatgctggccctgatcggtgcgggcaccgaccgctacctgttcctgtcccagaccccgaccgaacaacagttcgtcggcctcccccgccgctgacctgagccgctcggccccggccgaggtgacggcctccaccggccgcaccagacgcctcatcccgcacccacggaccggcatcgcgatccgggcagccggcccacgggatcacgggatcacgggatcacgggatcacggcctgagggtgggcgccggcgaatggccggtggcatgatgccgaggtgctccatgagcggcgttcccgccatcaccgcgtcgcggccgcactggccggccgctccgacggtgaactggcggcgtggctgcagaccgcatcgcccatgggcgtgggcgtgggtggcgacgcttcgagcatccacgtcgacggcgtgcccgtcttcgtgaagcggatcccgatcacccatcgggagctggctcatccctacagcacggcaaacctgttcgacctgccggcccggtggcagtacggcatgtaccgcctggccggtccgggtttcggagcgtggcgggagctggccgctaaccagatcgtcaccgagggggttctcgcgggcgaaacgccgtcgttcgcactgctgcaccactggcgggtgctgcccggccgcccgccgaccgcggcggagcacctcgacgtcgatgccgtcgtcgcccagttcggtggccaccgggccgttcgcgcacggtttgaggcgctggcgagcgccaccgcgagcctcgtgctgtttctcgagcatctccccgacgcactgcccggctggctgagcgacccggtggggagagccgcgacggtggaacggcaactgttcgagatggtggcgttcctgcgtagccacgaggtgctgcacctggacggacacttcggcaacatccgagccgacgaggaccggctctacctcgtcgacttcgggctcgccacctcaccgcgcttcgacctgtcgggcaccgagcgcgacttcgcggccgacaatgccggtcacgacgccgactacgcttccatgcggctggtgaactggctgatcaccgcgacgtgctcggtgccggccggcggcggtccggtcgcccgcaaccgcctggtacgccggtgcgcaaccggcgacattccacccgaggtgccggcgcccgtagcggagatcatcgccagacacgcccccgccgccgcccggatgaacgagttctgccggcgcctgttcgacggcgacctccgcgccgcatatcccggccatgcggatgcgatccggacacctccggatgacgcgacgccggtgacggcgtaggccacccgtccactgcggacgatcgaccacccggtcccgagacgaacctcatcaccccgtgagcgacccgggcggccccgcggctaccgggacggtagggcgccgggcgtccgggccgacgggcaacgggtcagtgggccggcggcgtccaggcgagctggaccagccgggcgccgtgcttgcgggtgatcatccaggcccggcccgggggcaggaactgaggtttgatcgtgccgaagagcgggccctcgtcgcgcgggccggacatcatgatgccgggggaggcgagttcgcggatgcggccgatcaccgggtcgaacatggcgcgggcggcgccgccgatgcggcgggtgatgaccaggtgcaggccgatgtcgcgggcctgcgggaggaattccagcagcggcagcaatggattctgtgcggcggcggcgaccaggtcgtagtcgtcgaccagaacgtacagctgggggcccttccaccagctgcggttggcgagcatctcgggggtgacgtccgggccggggaggcgttcccgcatggcgaccaccacctggttgatcaggtcggcggtgacctggtgggaggtgccgtagccgatggtgttctcggccgggatgatgccgagcaggctgcggcgcaggtcgacggtgaggatgcgggcctcggacgggctgttgccggccacgatcgacttggcgaggctgcgcaggaacgagctcttgccgctctcgatgtcgccgaagagcagggcgtgcggttcggcgtcgaagtcgagccagacgggttccaggtcggattcggcgatgccgatcgggacgaccgggccgcgggccgcgggcagcgcctcgaacgcaagctcggccggcagcagccggacccgcggcgcgggtgggccggaccagtgctcggtggcgtgcttgaccatctcggcgacggcctcggcgaggtcgtcggcgcgctgctcgcggtcgatgcggggcagggcggcgaggaagtggtgcccgtccggggtgaggccgtggccgggtgacttgtccgggacgttgaccgcctcccggcggttgatcagcgagtcgccgggctcgccgagccgcagttcgatgcgggtgccgaagacgtcgcggatctgcgggcgcacgtccatccagcggctggtcgcgccgatcacgtggatgccgaagccgaggccccggttggccagctcgttgacggtgggctcgaggtcctcgaattcggtgcgcagcgtggaccagccgtcgatgaccaggaagacgtcgccgaacgggtcctccgcgtaccggccctgggctttgacccgccggtacgccgccatgccctcgacgttgcgctgggcgaagaagtcctcccggccgcgcatcagcaggtgcacctcggcgatggtgcgccggacccggtccgagtcacggcggccggcgaccccgccgacgtgcggcaggtcagcgagcgcggtgagcgggccaccaccgaagtcgaggcagtagaactgcacctcacggggggtgtgggtgagcgacaggctggtgatcagcgtacgcaggaaattggatttgccggattgtgcgccgccgacgacgagcaggttgccggccgcgccggacaggtccagccacatcggatcccggcgctggtcgaacggcttgtcgatgatgccggtgagggcgtgcagcgcgccgaaccgctcggccgcgtcgacctgcaggccgcggtccggcatcgagatcaccggcggcagcatctggccgagggtgggcgccttgtccagcgggggcagccacacctcgtgcgccggggtgccgcgcccctccatctgccgggccagcacgtccatcagggtgtcaccctgaaccttctcctcgacctcctggccggccggctcggcggcgcggggctgctcctcctgcaggggcatcgcgtagtaggtggtgaactcgcggatcgggctgccggcccgggtgccgccggcggcgacggcgccctcgcggcggaccgccccggacacgtaggccgccttgagccggatcaggccgtcggtgccggcccgcagatagccgtggcccgggtgggacggcagctcgtaggcgtccggcacaccgaggacggcgcggctctccatggaggagaaggtgcgcagaccgatccggtacgacaggtgggtctccaggccgcgcaaccggccctcgtccagccgctgcgaggcgagcagcaggtggatgccgagcgaccggccgacgcgtccgatctggacgaacatgtcgataaagtcgggccggtcggcgagcagctcggagaactcgtcgacgatcagcaccagactgggcagcggcgccagcggcacgccggccgcccgggcccgctcgtagtcgcgctgcgaggcgtagttgccggtcttgcgcagcagctcctgccggcgggtcagctcaccctggatggcgccgagcatccggtcgaccaggggctgctcgtccttcaggttcgtgatcatcgcggcggtgtgcgggagccggtcgagcgaggcgaaggtcgcgccgcccttgtagtcgaccagcacgaagttgaggatctccgggtcgtgggtcagcgccagcgccaccaccagggtgcgcagcagctccgacttgcccgagccggtggcgccgatcagcaggccgtgcgggcccatgccgtcctgggcggactccttgaggtcgatctcgatcggccggccgtccaggccgatgccgatcggcacccgcagccggtcccggttgggccggttggcccagaggtcggccagctcgagttgatacgggtcgtcgacctcgagcaactcggccagccccatgtcctgggagatggccggctggtcaccggaggcggcggcggacagtcgcagcggggccagctcgcgggccagcacctcgatctcggggagcccgagcgtgtcggcccggcccacctgggtcgagccgtccatggtgacgccggtgatggtgccgtccgcggcgatctccaggatcaccgagctgtcgtcgagcagccggggcggcggcccggacaggtcgaggatggtgacgccggccacgccgccctcggtcatcaggtggtcggagccggccgtcgagccaccgtcgatgatcacgacgacgtgcgggccgggcggcggcgggccggtcagctcgaaccgggaccggctggccagcacgtcgtcgagcgaggcttcgagcgccggcacgctgggcgagaccagccggaccgagccggccgcgtcgatcttgtccgggtgctggccgtgcggcagccatttcacccactcccaacggggccgctggtggtccggcacgcagacgccgatgcgcaggtcgtcgggggcgtggaaggtgaccagctgggcggtcagcgcccggcagaagccgagcaccgcctcctcggcgccgcgcaggtagatgtgggagaagtcgcgcagggcgacggagaccggaaggtccgggacgacggagtacgtgttgacgaatttccgcagcgccatggcgcacagcggctccagttcgtcgaccggccgggtctgcggcggaaccaggcgggtcgccacctcctgggcgccgaccgcgatccgcaccacggtgaagtcggcgtcgttgcgccgccgctcccagagccggccgctgtccgcgaacgtccacagcgtggccgggtcgggattgcggtagtaatacgcctcgcgctgctggcggatcgtggcgcgcagctgggcgcgcaactgggagaggtgccgcagatactgccggcgagactcgatcatctcgcgcttgccggggccggaggtgttggtggccatcatcgcgatcatgccgaggatggacactccgtacatcgcgccggcgacgtaggtcagcgggccgccccgctgggcgctcatcatcagccccatcccggccgcgccggcgcccatcggcaggaccatcagcatcctcgtccagcccttgccgccgggcggcggaatctccggcggtgggtcgagcagcacctcgccggagggcatcaccggcgcgggccggcgcggggggcgcttgacgatggtgacggtcacgcttggctctccccgagtacggcgaatctcccctgcacgggtcggtgtcgccgctcatcctagctcccggggccggcgaccccggccccgcagccattcgccggggcgaatccggcccggcccggcctgctagtttggtggcacagaaggcacagctggaggtgaccgcgtgaccgcaccgggtgggccgagtctggcccgggtgacgatcgccgcgccgacccggcggatggatgtcgctctgcccgacaacatgctggtgggagagctgctaccgcacctgctgcggcacgccgagggcgcgttgggcgagccggccgagcggcacggcggctgggtgctgcgccgcgccaccggcgccgcgctggagccgcagcgcaacctggccgcccagggcgtgcgcgacggcgagctgctgcatctgaaaccggcccgggaggactggcccgagctggcctacgacgacgtggtcgaggtgatcgccagcggggcgcgccgggccgggcggtcctggggtgccgccgcgacccgccgggccggtctggcggtcttcgcggccgccctgctgatcggcctgttcgggctggccgccggcggcccggcccggccgaccgcggcgatcgtcgcgctggtcgtggcggtcgcgctggccgtggtcggcatcctgctgtcccgggcgttcgccgacgcgggcgcgggcgccgtggtcgccgcgagcggcctgccctacgcgttcctcggcggggcctggctgatcgccgactcgggcgcccgcttcctcggcgtcggcgcgccggccctgctgctcggctcggcggtgctgctggtgctcagcgtgctggggcacaccggggtggccgggttgccgcggctgttcgtgggcggcatcgcggtcgccctgaccggtctgctggccgcgctgctcaccctggccggggtgtccgcggccggtgccgccgcggtggcgctgaccgccgcgatcggcctgctccccggctatccggtgctggccagctggatcggccggctgccgttcccggagctgcccagccgggccgaggagatcctcaaggacaagccgatgccgcgccgggcggacgtgttcgccgcggtggtccgggccgacgaggtgctcaccggtttcctgctggcgaccgcgttcagcagcatcgtggcgatcgtctacctggcctggtcgcacccgggcacaccggcggtgctgctgatcgtggccgcggtcaccgcgctgctgctgcggtcccggctgctggcgacgccgcggcagcgcggcccgctgctggtggccggggtggccggactggccgtgctgggcgtcggcgcggtggtcaccggcgcggtcccgggcctgctggtgctggccggcgcggtgctggccggcgcggtggcgctgccggccgcggtggtctacagccagcggcagccgtcgccctatctgggccgggccgccgacctgctcgacgtgatcgcgatcatggcgctgatcccgctggcctgcgcggtgatgggcgtcttcgacgacatccgcggcctgctctcgtcgatcggcgggtgaggcgcggatggcctcgcgtcgcgatcagctccagtcgtaccagttcctgaaccagcgggtgatctccgcgttcgtgatgcgggagaccgatccggcccagtcgccgctgcggcggggtatcggcgcgctcttcggcggcctgatgatcgccgtcctgatcgcggccggtttcggcatctacggcatcctgaccaaggtcggcggcgaccagtggcgcaccgagggctcggtggtggtcgagaaggagtccggcgcgagcttcgtgttcctgcacgaccggctcaacccggcgctcaacttcacctccgccaagctggccgccggcaagccgaacccgcaggtctaccgggtcgccgcgaaggcgctgaccggggtgccgcgcggggtcaccatcggcattccgggcgcgccggcctcactgccggccgccgatcagcagtccggtctgccgtgggcgatgtgcctggtgccgggcgagaacccggcggccaccctgctggtcggcaccgccgggccggccggcgccgacctgggcgacaaggggctgctggtcaccgatggggcgggcaacgtccaactgatctcgcacgggtggaagcaccggatccaggacgcgcagaccaacctgccggcgctgttcggcgcggtcgacccgatgcgggtcagcaccgcctggctgaactctctcccggccggcgccgacatcgccgcgatcccggtgcagaaccggggcgtcccgtcgcgccgggtgaccggtctgaacaacggtcaggtgctcgccaccgaggtgggcgtcaacggcacccagttctacctggtgctggacaacggcgtgctgccgatcaccgccctgcagaaggcggtgctgaacgccgctttcccggccgagccgaagaatgtgccggtcaccgtggtcaccggcgccccgcagctcaagccggccggcaacgccgacgcgcaacccccggccgacccgcccaaactggccaccgtggcggccggcacgaccgcatgcgcggtcacccggtccgcggccaaggcgccgtcgatcgtggtgggcggctcaccggccgggctctccgcggcggtgccgaccaccggcgcggccggcgggcgggcgctggccgaccaggtcggcgtcccggccgggcatttcgcgctggtgcacgtgcccggttcgggcggctaccaggtgatcaccgacctgggggtgcggcacgcggtgccggacgcggacgcgctggcccggctcggttacaccgccgcgtcggccaccgaggtgccgaccgccctggtcaccagcatcccggccggcgtcacgctggacccggtcgccgccctgaaaccggtcaccggcaccgactgacgatccggggaccaccgaccggaaaggacaagcggcaccgatcagcggtccggctggtccagcagcatgaccggtggccccggctcgatcggctcggcataggacggcggtggcggggcgagcgccgggcgccagtgctgccgccggctgcgccggatcgccgcggtcaccatcagcaccgccaggaccgcgacaccggcgatggtcgccccggtgaaggccgccgcccgccgccggttctccaccccgctgcggccggccgccgccgggctcagggcgggcagggcacggggccgccggtcgctgacccgtccggtgacggccgcggacgggttcaccacgccggccccgaacgcgtcgccggtcaccgtggggctggccgacgcggtcagctgccgggtcacctcggccaccggcagccgcccgaaacgcgcgcgcaccagcgccgcggtggcgcccacgtagccggccgcgagtgccgtcccgtcggcctcgaccaacccggcggacgccccgtcaccaccctgcagcgtgggcaccgccaccccgggggcgaccagatcgacgtacggtccatgctgggatttcgggaagatcgcgccgttctgatcgatcgcgccgaccccgatcacgccggggtaggtcgccgggaacggcgtcgggttcgcgtcctgtgccgcgccgaggtcaccggccgccgcgatcaccggcacgtccgcggccaccgccgcggccaccgcgtcgcgcagcgccgcactgtcctgataggccggctcggcgaccacgatcacgtcggcgccggcctggaccgcgaagctgatcccacgagacagggcggcgggttgcaccgtgccgtcgtcgccggtgacccggaccggcaggatggtcgccttgccggccagtcccagcaccgggctgccgtccgcccggtcggcggcgatcacgccggccacctgggtgccgatcccggtgcagtcggtgtccgccgcgccctggttgcgcaccgcgtcgcggccggccaggacgcgcccggcgagttgccgctggccggcccgcaccccggtggagagcaccgcgaccacgactccgccgccccggctgaacgaggtggccgagtcgatcgacagcatggtgcgcggccaggccgtcgaaccggtcagccgggccggacgggcacagtccgcggccatcgcggcggccggggtgacgacgaccgcgatcaggaggaggaacacggccggcagcccccgcagcagggccatcagcgggccgccagggcggcgcggcgggcgagcaggtcggcgcggcggaagcgttccggcgaccgggcccgcgccgcccggccggcgtcactccagaacgcctcggccggcacctcggcggcgtccgccggcaggaaccggagggcctcgtcgaggcaggccaccgcgatcagcagggagccggggtcgtcgtcgatctcggcggccaggctgagcatgtcggcgaggtccacccactcgccggcgtcgaacagctgggacggctcgctgccgaacgtcacgtactccccggcccggggcggtgtcggccggtccggcagagcgaagacgaactcccggtcgcggccgcagcccccgcaccggccgtgataccggcgggccagcacgccggaccggtcgaccagcgcctcggcccaggtgacgtcgacgctgccgcagtcgggacagccgtgcaggtccatgtagaggtgggcttcgtcgcgagtcctggcaaccggtagcacccgccgatgatatgccggtcgatcccggttcggcgctaccctgtgatgcccggcccttctcccccgggagcccgatgaagaagcggatcatttcgtacgccgtcgccgcgttgctcaccgccgtggtcgtcgccgacctgctcagcggtggccggctggtccggctgccacagcgcgccgacgcggcccgggagcaggccgcgcagatcggcgcgcggctgcgggcggccggcacggcgaaggtgaccttcgaggcgtcgatgaatccgggcggatcctgggccggcaccagcacggtgcggttcggcgacaccccggtgtgggacacggcgtacacccgcgcgacggccggaagccgccgcatcccgctgcgaaggctgcatctccagcgccgggacttctactcctccccggcgctgaccacggccgacgcccggccctggatcccgccggacagaatcgggttcggccggctgtcctcgccgggcaacaacatcagcgacctcaccacctggctgccgttcctgaccggggcgggtgagcaggtcgcgccgcacgaatacgagttccgctgcgacgggacgtccgccgggtgcccgccgccgctgcattccgacctggacagctacttcaacgcggtcccggacggcccggtgatgcgggcccggctggacgacgagggccggctggtccgtctgcaggtgaccgcggtgctcgacaacatacgcggtgacgggtcgcgcggcatcctggtcccgagcgatgtcacggcgaccttcacactcgccgacttcggcacgccggtgcaggtggtggcaccggccgaggccgacatcacgacgacgttcgtcagtcttccggggtgaaggcgagcagggccagcacctggtcctcgggcagctggaacgcggagtcgctctccgggtcgaccgagagcccgtgcccctcgggccacagcgccagggcgaacgccagcgacacctcgacacgctccggcggctcgtgcgggtgccgccggtcgaatgcctccgggctggtgaacacctcgatcatctggtcgtagccgggcagccaggggaacccgtcgcccaggatctcctccggctcggccgggcggctgaccgggatcagcacgttcgcgtcgagcagccggtcgaggtagccgtacacgtcgccgacctccaacgccgcccgcagcgccgcccggtcgtcgtccggatactcggccgggtcgcgacggcggtgccgcgcctcggcgtcggcgatcgcctcccgctcggccgactcggccagctcacccagggtcggcacccggatgtcgccgagcgcggcctgcatcagggtctcgatcgagaggtacgcgtcgatcggcgtacccgggttgatcgcgagccgccagtccgggtccggccacttgcggctgagctcggcgaagttggtcaccgtgtagccgtcgacggcgtgcccgacctgcgcggcgagcgcccgcaccgaggtgaacaccggcagcatcacctggccgagcgcgtggatggtgaggaagcgctgcgggccgtccccgctcatccgcggcaggtacaggtcggaggacgcgaccacctggaagaacgtctgccggtcgtcctggatcgcggcacccagcagggtctcctcgaccccgttgccgggctcccaggccggggcggtcacggcgcgacccaccgatgcgtcgcggggagcagagcacccagaccgtccggcgcggcgagctcggcactcgcggccgcggcccgcgccagatccgacaactcggccggtacgggtcgtaacgccagccagaacgccccgaagtcgccggcgagacgatgcatcagccgctcgcagcggtcggccgcggtgaagtggtcccggtcccgccagtcgtcgtcgtccaggtagccgaccgcgcccacgtccgcgccccgcacccggatcgccagcaggccgccctgcacgtgcccgatgcccagccagtccggcgtgagccggtcggcgaaccaggcgttgagataccccacgtcctgcagccggtcgtcccggaacccgaacagcggctggtccagcacgaacccgtggcccgggaacacgctgggcccggcgggggcggcaccgttcgtccgcagcaggaagtcccggtagtgggccggaagcgccaccttcaggatctcctcgcccaccgccagcgccgcctcggtgagccgctcgccgaccagcatccgcggcggctcgccggcacccgccgtcaggccgcgaccggcggcgcgcggcccgccgacactgaccccgcccaggtgccggaaaccggcgtgcagctcggccggtaccagcgcgaggtgccgggtctgcgcgacgtgcgcccaggtccagccgaccggcgtgccggcggccccggcccagagcgggtcaccggcggcccgggcggccaggcccgcggtgcacacgtcgaccacccgcgcctcgtcgacggtcaggtcggggatcgccggcggcaacgcgaccagcagccgggcgtacggcgtccagtccgggaaaccccacgggtccaccgggacgccgaggcggtagcgcacccgcagcatcgggctggccgggtgcgcggcccggaaagcgtagcgggcgccggcgatccgtccggtcacggccgccactcccggatgtcgccgaggtccggatccaccccggcggccgcccgggccgcgcggaccatctcccacgcctggccggccggcggcatccgatcggccgggaactcgtacacgtcgtcgtccggtgaccacgccgggaggcccgtctcggcgagccacacggcgcgcaccgcggccgcctcggcgagccggccgtcccgctgccccggatcggtcgcgaactcgcgctggatcgtgctgaccagcgagtcgtacgcggccagcgcggactgcgtcgcatgcgtcgagtatccggtggccacgtcgagtccggtggcggcccgctcggcccgctgaagctcgaggcgttgcgccggggtggcccggcggtcggtgaggtcgctcagaccgtgccgggccacccacatggcccgcacctcggcccggagccggaccaccttcaggtagtcggagtcgggccccccggcgaactcctcgtcggtcatcggcggaatcccgccgtccagcagcgcccagcgggaccgctggtcgctcagccagcgacgccggaaccgctccggtgccgcggcccgcgcctgccggctccaccccgtccacagcgccgactcgggcaggtcctcgtcgtcctccatggtggtccagaacttcgccgcctcgtccagggccgcatcggccacgtcgagcagcgcctgcacggtcttctgctggtcacgcggcagcgcccggatcccgggaatgctctgcgggaccccggacaggtatcgctcggcgacccacagccactgcccggcgtcgatcagctcggacggagcctcgcggtggctgaagccggtgctgtccgggcggtcgccgaaacggaatcggaacgaccgctcccggccgcagcgcgggcagacgccgaaccaccgcacgcagtccgcctcggcgacgacggacggggtgaaggcggtctccccgcactcgcacggggtgaggtcgaggtacaggtacgcctcggcgtaggtctgcgccaccagcacggtcatcgcacgaactccccggtcgccgggtcctgcccggccgccgcccgcgcggcccggaccagttcccaggcgggctcggccggcggcaaccgatcggccggcatgtcgtactcgtcggcgtcctcgtcccactccgggtagccctgccggacacaccaggcggaccgcaccgcggccaccgcggcgagccgacggtcccgctcggccgggtcgtcctggaatcgggcgcggatctggtacggcagccggttgtatccgctgagcgcggtccggccggtgtcggtgggaaagccggtggccggatccttctcgtagctgggcggccccggccacgggcgcggctcccagactccggaggaccggttgtagctctcccagagcggggacagtccctcggcgccgagtttctccgcttcgttgatgcaggccatcgcggtgcgcatgcgcatcgggtcggcgggcggagccgcataccgggcggctgccgcaacccactgatcggcgtcgatcagctccgagggctcgggaccgccgaaccgtggccagcccggctcctcgatctccggctcggtggacatccggtagacgaactcccggggccggccacagttgtcgcacggaccggcgaagcgcacctcggcgaggccatcgggcagcaacgtcttctcgggctcgcgggggaagcgcgactcaccgcacacgcacggatgcagatccatgtgcaggtgcgcctcatgctcgctacgggcgcgtggaaccggcatgcgaccaccctgccacaggcgtatagggtttgacccatgcgggaccccgacgacgaccgcgacccggcccggcacctgctgtcccgggtccgctaccggcggctgccggacggtacccagcagcgcgtcccgatcaccctggaccaggccgccgccgagttcggcgagctgatcgacgccggccggccggccgaggtgcgcctcgacccggacgagggccgcgacgaggtcgcggcgttctcccggcagcgggccaaggtgatcgcctcgctgctcgacgagctgtcccggcgggtgcgtccggggctggccgtcggcccgatccagagcgacggcaagctcgccgacctggccgccgagtccgccgcgcacctgcgcagcggcaccggttactgagaggagccggcatgaccccggacccggcccggcactggctgagctaccccgtccaccggggtgatccggagggcttccggccgaaaccgctcgatgagttcgccgccgacgcccgcccggccctggacgcgggcgacgccttcgaccaccgcaccacccgcggctcgcgggacatcgtgtcgatctccgtgcagcgtgccggggtgatcgccgctctgctggacgagttggcgctgcggctgcgcccgggcgtcgaggcggggccgatccaggccgacggcgagctcagcctgctggcccgcgagctggccgacgacatgtaccggtgggcgtcacccgagtgagcggaccgccgaccgggcggcctcgaccatctcccacaccgccgcggcgggcggcagatcggtgtccggcgtctgccagatgtccccggcccagagggcgtcgcgccatggcccgtcgctgatccgcagacggtccagccacgcctggtacgccgccagggcggtgccgatccgcaggtcacgggccggcacgtcggccgccagcgcgatctccagatcgtcgatgaactgccggaacgcggcgaacccggcggcggcgctgtcccggtccaggccggtctccgggtccagaccgtccatgcggcgcagctcccggtcgatctcccggttctgctccgcggtgccggcgccgatcaccggatcggccaggccgtgccgggcggcccaggcctcgaccgcgcggttgcgggccagctggcggcggacctgctccgggtcgcgcgggggcggcgggtcacccggaagggcgcgcagccgccgctcatatcccagtcgccggtcgatcaaccgctgccgggtgaagtcgtccgggtcccggccggccgggacgtcccccggcggcagccggtcagcgccgtccggcaggaacttcgccgcttcgcgcacggccgccacggccgccatcagccaggtccgcgcggtcgcccgcgcttcgccggtgagatgttccggatcgcggggtacggcctcggcatactgctccgcggcccatagccactgccccgggccgaggagccgggaggggcgggtgccgtagccgtacacgatctgccgggtgctggtggagtcctccggtacggcgggcatcgcgaacacgaactcgcggtcgcgcccgcaggtcgggcagcgtcccgcgtaccgccgtccggggttgccgtccggcagcgtgaccggctcgccggcggtggccagccggcgatccccgcaggcgcacggggtgaggtcgatgaacaggtgcgcttcctggcgggtccgggccaacgggtgggtcatcgccggatcatccgtcgtcctcgtccgaccagtcggcgatcgccagccactcgttgtccgcccaggtgagcaacaccgcgacgggcagctggtcgagcacgatcgtggcccgctcgccgggccaccggacctgcgggtggtcggccggcctgccgtcgcccggctcgcccaggatcgccgtgccggtccggaccgccaggtcgaacaccccgggcaggaagtccggcggcgcctcgggcagtccggctaccgaagccagggtgatactcacctcgtccaccgcgccgcggctccaggccagctggaccgggcggcgcggagccggccacggcacgtcggcgatcacaccgttgtcgtcctggtaggtgacggtccatccgaagcgctcggccagggccggaaacccggcccggtcccaggaccactcggtgtcccgcagcgttctgaacagcccctccagcgacggctgatcggcggcgggcggcagctcagtcatgatctccggtcctcagtggctcgtcgccgaccagccggatcgttcccggctgcaggcggtcgtgatccagcaggtactccgtgacggtgacccgcccgtccgcggccgcgtgcaccttcaggaagcgcaggctgcccagacgctccgagctgatgatcgactgcagcagcgggcggagctccggacgctcctcgagcaggggccggagcttcacgtcgtgctgcagcatatgcctcaggtactcggggctgcactgctccgcgcggatcatgacaccgccgagatcggccgggttctccacgttgcgcgcctgcagcgtgctgccggcgcccttctcctcgatcgcgatgatcgccgggccaccctgccgcggatcctcgaccaacaggatccggtcgatgttctgcggggtgccgggcttgtcggagacggcgccggtcagctcccgggcccccgggaagtgccgctcgacgatcaggtcgccaccggccgtgccgagcttctcgctggccagcttgacctccttcgtcaagcggatgtactcgatcccccgggcccgcagcgcgctgctctgggcgtcggacaggaacggggccgccttcgtcagggtgtcccgcagcgacgccccgcccagatgctgcgcgtcgagggtgatcccgtgcccctggagcacccgggcgagcggtgcgaggtgccggttccagacctcgttccgctgggcctcgaacgacgcgcgggcctccgccgcctgccggacgccgacctcggtggtggagtcgcccgtcgggtcgtactggcgctcggagccgcggtccggaaccgcacgcgcagcggcgtccccggtcggcggcgggttgtcgtcctcgacgttgcgggagcccacccgcggccggccgtcgcggttgcggctggtgccgacccggtcaccggggaagtgatccttgccgtccggcccgagcatcagcttctggccgtacgtggtgtcgcggcgaccgtcccagacgagctcgtgctgctgccagcgacgctccgggctggtctcaccgggccggacgtgctccacggcgaccggctcggccgccgcgtgcgcgggctcccgcagcgggagttcggcatgccagctctcgccggccatcacctcgacacccagcgaggtgccgccacggtgccagcccgcctcggtgccggcccgcgcgaactcctccggccgcgggaaccgcggatcgccgaacggatgctcggcggcccggcgcagtagtccctgcccggcggtcagctcgcggcgcatgttcgccgcggtctcctcgaccgtgccgccgccgaaccgctcgcgcagcgccggcacatccgcgccgccgtccgccagcgtgtccagggcgtgccggatgtcgcgcacccgctcgtccaggccggtcaggatccgggcgacgtccgccgcctcggtgccggtgccccagctgtaaccgcgccgggcgagctcgtaaccgtctcgtccgatggccggcgcctcgatccggtccactccggactcccggtaccactcggcgagctgccggtccacccgcggatcgagggacacaccctcgtgccgggcgaccacgctgccgtccggctcgcggatcagcacccgggtctcggtgcccagcgggacgccgttgcggtcgtcgacccggagccggatcaccatctcgtcgggtcggacggtgatcgccgcgtcgccggccagccgcagggcccgcgtgccgatccggcgttcgtccagctgccgggcgatctccgcggcggcgtgctccgaccagcggccggcctccgcctcggaacgcgggagcagttcgtcaatcgtgggcacccggccctcggcgtgccaggggcggccgatccagcgcagctcccgggccggctccggatagccgagccgggtcaggtcgcggtccaccccgtcgatctcgtcgcgcaggtgcgcctgcaggtccgggtcgccctcggcggcgtccaggcgacgctgcaggtggagccgttcgttcatccgggcggccgcgtgcgggtcgaccggcggccggtcggcgcccagggcgtgccggatcgccgtcatcgagcggcgcaccaggccctggtcggccgcccggatctcgccggcgtgccggatcgccagcgtctcgctgatctcgtgcaccaggacccggctgagctggtcggtggcgacccgatggttgaccgtgaccacgtgcggactgcccggcgtgccgtcgccgacacgggtctcggccaggtcgtccatgtcccggccgatctcggtgacgaagtgccgcggtacgtcgtcggcggtggtgacggtgatgacgtgccggccgtcagcctcgatcgcgtgcacctcgccaccggcgaagtcggcgccggagatctcccgcgcggcctcgtgcagctcggtcaccgaaaggtcggccgcgccctcgggccgcccgtccggcacgaacgcggtgtcctcgatcgggctcgccgtatgccgcgggttctcccccggagggccgtcatcacgaccatcggcccggtcatgcgcggtctcctcaccacgcggggcggcccggtcatgcgcggtcgcctcaccgcgcggcgtcgacccgccgtgcgtggtcgcctcaccgtgtccgcttccggtcgtcccgtgcgggccagggcggtccggccaggcgaagccgccggtcgcggcccgccgttccggccaggccgacatctccggtctttccggtacgtggtgggccccctcgtgcgcaccggtccgctccgtcaccgcacgcggcgagtagaccggatcggcgggcgcctcgccgcgcaacacgtccagcacgccccgggccgcattccccggcgcgtaccgctcgccgaggaagtcccgcaactccccggcccgcgcatagtgccggtccagcccggtcagcgccgaccggacgtgatccacccaggcgcccagccggtcgtcgtccaccgcggtcagcaggtccttgaccaccttcttgggcagcacctcggcgtcgccggccaccgcgtcgacccggtcgcgcagggcggccacggtgttcccgtcccgcaccgtcgcggcctcgcccagcccctccggcacataccgcgagtcgccgaagaacatcccggcaccggtgccctcgggcaccaccaccggcaccccggcctgcgccgcctcgctggccaccagcccgaaaccgtcctgaatggacggcatcagcaccagatccgcgtccatcaggtcctgccgcagttccgcccggccctccggggtgccggacgggacgaactcgcgcacctcgaccggatgcccggcgatcgcggtgagccgatcagccatcatcggcccctgcccgtccggggcgccgcgcacggtcagccgcacgtcgacgccctcggcccgcagctcgcggaccatccgggcggccatgtcgacgcccttgatcgcgtcgtcggcgcgaccgcgcacgtgcagctcgtacccgccacccggggaccgggacggcgccgggccggtgtcgcgcggcatgtcggagatgatggtgtgcgccggcaccggacgctccggcgacgcctcccaggccagccgcccggcctcctggccgagcagcggcccgatgccggtgaccaggtcggccccgtccatcagggcgcgctcggtggccgcccggtcgtgaccctcggcgggcaggccgcggaccccgtccagcacctccggcgaggtgtgcagcacgtggacgtacttcgcctccggatagacgtgctcctgcagcacccgggccgcgccaccgccgaaccgggaattgccgacgatcacgtcgacctcggccggcaggttgtccagcagcatcgacatggcgcggcgatcgggccggtccttctcgtccagcacgccccagacctcgcggacgccacgcacctcgatgccctgcccggtggtgagccgggtgagctccggacggctctgggagaccagcgacacccggccgtacacctcggcgccggcggtccggaaactctcgctcagctcgcggttcgcggtgatcacgccgccggcgttcgagtcgtactcggtgcagacggtcatcacccgggtggtgccaccggcgggcggatccccggcggcgttgcggcgcaccacctcgcgcgggtcgagggtgtcgtggaacgtctcgtcccggacccgggcgacaccgtcacccaggccgccgatcgcgtcgtgcacgcttctggcggcggccgccgggccgtaccgctcctgcagctcgcggctcagcgacagggcgtgctcccgggcaccggggtcgaaggcctgccgggcccggtcgacccagccggcggcgtcggtgcccgccgggaccaccgatcggcccgcgtgctccggcgaaaccttctccgggtcgccgaacagacgcccggcgccgctctcggcgtgcgccagcaccggcacgccgtcgccggccgcctgcagcaccaggccgtccagctggggccgggccaccgggtcgagcaccacatccgcgtcgcgcagcagctcgcggcgcccggcgacgtcgtcgggcagccggcggacggtgacctcgctgccggctgcctcggccagccggtcggcgtgccaggccgcctcggccccctccgggtcgcgcaacgccaccgtgagccgcgcgtcgacaccctcggcgcgcagccgccgcaccgcgtccgcggcggccagctgggaccgttcgtcgccggtggccagcacgtggtagccaccctgccccgggatccgctccggcggcggaccgccgtcgatcggcgggatcagctcgtgcaccggcggaatcggatcggcgcggtgctcggtgaacgccgcgcgcaggccgtccgcgacctccggacccaccgcgatcaccaggtcggcgcgggacagcacgtccaggtgcgccggatcggtcggcaccacgtcgatgatctgcaccacccgggcatccgggaaggcgtcccgccgcgcctcggccaccccggccgtctgtccatagccgacgatcacatcggtgtcggccggcaggtgatcgggacgcagcagcgggctgatccgcccggtgacacccggaaccggctcggccgggatggcgcggacattcgggcccagctcgccggcctccaggtcgggggcgcgcagtgcgacatggtcaccctcgccgcccagcgcgatggccagctcccgcagcgtgccgcgctgcatcggcccgtccgctacgtcgtcgaacgcgagcagatgctgcggagcggtgttccgccactccgcgacccgcggcggcaccgccggttccagatgcttgataccggcccagctggaggtgagcaacgcgtccttgccgacccagtgcgcgtcccggccgtgctcaccgcggtccccgacggcgagcacctgctcggtggtcggccagtccgccagcagacgctcacctcgggtgatggccagcatccggttgtagatctcgcgcgcctcctggcgctggctgatcatgttgtcgcgcaattccgacgggttctccccgccgtacttccggtaaagcgggcgcagttcgtcggcatcccgtcggctcaagccatccaacagctcgtcgatccggtcggcctccaaccgcaggcgctggatcggatggacaccaccgcgcggttcccaggcgtagccttcccgtgcccaggcgaacccgccgaccttctcggtgttcacatggatgtagcgaacaccggactcgcgataccagccttccaggtgatcattgaactctccggcgaagcctccgccctggacgccctcggccaggtagaaagcctcgttcttgaccaccaggaagttctcttccggctgccgcctgaaccactgggtcgagcggccgacctgtcgtcccgcttcgtccagcacccgcacgtggacccgcaccgcgtgctgggcgatctcgaccttgttcacctcgacgtgcttgtcgccgtacgtccggccctcgtacctgtccttgacggcctcctgaatcgctccgtgccaacgttccgcctgctcacgggtgtgcgggatgaggtcacccacgggtggccgctcccccgcctgccacggtgggtcgacgagatgctcggggcccgacgtcccatccggcccggaaggcccatcggggtcatgtgcgcccgcggcggcccggtcctccacgcccggagcagcgtggtcatgtgccccggaagcggcatggtcatgggccccgggcgtcacctggtcatggacgcccggagtgggatgtcgcgatccgagcacaccacccgacagccccgcgggccgctccaccgcgaacgggttgacgttgtgcccgagggcccgcaggtcccgctccacgccggtgatctcgtggcgcagctgggcctcccggaccgggtctccggccgcctcccggagctgccgctgcagatgcagccgctcgttcatccgggccgccgcgtgcggttccaccggcggtctcgccggggcgtcgccaccggagaagaaccgcccgatgctggacgcggcccggcgcagcagcccctgcggcggccggcccacctcctcggtgtgccgcatcgccagggtctcggtgatctcgtgcacccagacgcggctcagctgctcgggtgcgacccggtgattgacctggaccacgtgcgggttcgcgtgggtgccggcctgtaccgagaccttgcccagggtatccatgtcccggccgacctcgaccacgaagtgctcgggttcggcccggccacggacccgcacctcgacgtggtcgccccggtgcgtgacggcctcgacgtccccggccgagaagtccttcgggtccacgtgctcgctggcgtcccgcatctcctccggggtcaggtcgggcaggtgctccggccgcccgtccggtacgaaacgggttccctcgatgccgctggcggtgtgcgtgaccccgccgaccggctcggcccgcagcgccgggtcgtatcccaggaactcctcgggcggcggcccgtccaggtaccggcggccggtccaccgccggtccaccatcgcgtccttgcccagccagtgctgatgggcccggtcggtgccgtgcagcgactcccggtagccgaggcgcgcgatctcaccgggcaccgggtacgcgtggcgcggcttcgtgccgtcggcgacgcccttggcccgatcgagcagatcctgcgcgtcccggctctgctcgcgcatgttccgggcgagttcatcggggttcgcgccgccgaacttgtcgtacagcgaccgcagccgctcgggcccgtaccggtcgaggttgcgcaggtcccggccgatggcgtcgacctgctccttgagccccttcatcacctcgtggccaccgtggatctgccactcgtagccggccgcggcccagctgtatccgcccaccttggtggcgcgcagctcgacgaaggacgcaccggactcccggtaccaaccctccatgtgccggttgaaccggctcgcgaaaccgtgtccgcgggcgtcctcggtcatctcgagccggttgtgcttcacccacaccgtgccgtccggctcccggaagagcccccgggtgatctcgcccacccgttgcccctcgggcgtgagcacttcgagctccaccaccacgtagtcccggcccacctgggtgcgaccggagcgcacccggacctcgttcccggcgaactcgtggccgtgcagtttcgcctggatggcggcgtcgatcgcgtccgcgcggagcgccgcctcctcgtcggtccgcggaatcagatcgtcgatcggcggcgtctccccgggcgcccacggcgtccgcggatcggtcggatcgtgcggcgtcgccggcacctccgccgggtcgtgcccgctcttgccgtcgtgcccgaactcccgatcctgtgcctgctcagcaccctcgtgaaccggctcgcgatcatgcggaagcccgtcctcacgcgcaggcagaccggcacgtggcgaagcctcgtcccggaccggcccaccatcgcgcgcggtcacttcatcgcgcgcgatcgcctcgtcccgtgccggcacaccgtcgtgttccggcccccgggacaggtccgggtgcggcgtagcctccggccggcgtggcgccaacgccgccagatccggaaactccgacctttctgtcctttctgtcccttcggacctttccgattgctccggacgtcccgcccgttccggctcaaccggcctcgccggctcggcccggcgcggctccagcgcctccaggccgcgcaggtgcgccggcggctccgcccactcccgcggcgtgacccggtcgaccgcttcgtctccgagcgcccgcaggtgctcagccaccgcctcggccggcttcggccggatccggccgtgctccccggcttcggtcaggtgctcctcggcccaccgcggcaacggctcgggcacatgccggccccgggcgatcgactggatcgtgccatcggtcagctccgggggcagcggcggctcagccggctccgccgcatgccgcaccatgtcgtcgtgatcccgtagtccgacctccggccgcgcgtcctccaacccccacaacgcatcccgcggagtctcccgggcgcctgcgggcacatcggaaacagcgtcacgcggcgcatcggcaccaccatggcgcgcgaaatcgggagcggcctcacggggtacgtccgttacggcctcccgcggcgtcccatcgtgcgaagcagcctcacgaggcacatcggttgcggcctcgcgcggcaccccatcgtgcggtccggcgtcggcggccgcaccatccccacgggacggcgggaggtcacccgccgcaccctcgtcaccgatcgcctcgagatccctcggtgcgccttcgccgctgtgcggcgccggctcgcgccctcccggcacggcttcgccggccggcggtcggagctgtccgccgacctcttcatgcagtgcccgccaggcgttgtccagattcccgcgtacgtacgaggcccgcgcccccggttcggccggcacatgcggggacagcccgatcgcggccccgtccgcctgccgccaggtgccgtccgcgagctgttccagggccggccgccgcagcaccggcccgccggccggcagcgactcgttcacctgcacggacacgtccacggtcacgccgtcgccgtaccgcacccgcagggtcgccgactccgggtcgaagtcggcccggtgcggcaggtccggcgctcccggctcacgtccctcgatcagcgcgccgatctcccggtcggcgaccgtctccacgtcctcgggtcgcgtcaccggccggtccggagccgccccgtcgacctgcaccaggcggaacggctctatgcggcgtacgtccccgccgccggccacgtccccacggtccgggatgtccggaccgccttcgccgcgaccgccgcgaacgccggcgtcgccgccccgtccagcggcgtccccgccggcgtgtccttgtcgatcaccagcgcccggtcccggctcggatgcccgtaccggcactccaccgtggtcgggtcctcccgcgccttccggaagccgaccagaatggccatcccagggatcccgccctctgctcgtctccccgcccgccgccacatcgcctcgagaagccccgtgccgtccggaagccgcccggtctccgccaatcgccccgcgctcgccaccaacggcggcacgatcccctcccgccggcccccgctcgccaccgatcggcgcacggtcgttccccacggcagcacgatccacagcagcacgatccacggcagcccggtcactaccgacccgggcacggtcactaccgaccggggcacggtcactaccgaccggggcacggtcacccccggccaggccatggtcggccccggccgggctccgctgcatcccggcggacccacggccggccggaccgacccgatccccgcccggcggcggcccgtccccacccggacgcacaccatccaccgacgcgtgagcacccggactgtcccccaaggaaccggcagccgtcccgcccagccggtcgggcgccgctgtcccgtcgacacgacccgccacctggctcggcgtctcgctgcgcggagaggcgggtgtcccaccatccggcggcggcccactgccgtccggcagatgccccctgcccccactgtccggcgcggtcggctcacccgcctggcccacagaccgctcaccagcatcgggaccgctgtggcgacctgcatccggcgtagtccgatcaccggccccgggcacaccgcggtcacccgcacccggcgcgctccgatcacccgcgccgggcacaccgcggtcacccgcacccggcgcgctccgatcacccgcgccgggcacacctcggtcaccggtcccaggcgcggcccggtcagccgcgccggcggtgtgctcggccggtgccgacgacgcgtagttcgccccggcggccgggctgcccgaggcagtgccggcttcgggcgtacgcaccggggaggaaacgtctccaccggatcgcccggcggcggccgcggtcctgcccccgtcggcggccgcgctcgggccctagctagctagccgtgacacccggtgacggcgactcggtccggaccgtggccggctccggaccccagttgtcggcgatgtgctgggccacctcgggccgcgcggagacctcggcgggcaccacccgcagcgcgccgtcaccgccgtggttggccccctggtacgcggcgtagccgttgtcggtgagcaccaggtgctcccggatgccgagcttcgggttgtcccggaaggagaccgcggagaagctgccgtcctcatgggacaggatgtgcaggtctttgccgatctgcagtttgccggcgccgagcgtgctcatctccaggtgggtctgcccgccgaagatcaccccggcctcggcaccctgcaccgcgccgtgcccggcttcggtccagttcaggtccttgatcccggtgccctgttcgagctggctcatgatgtccaggccaccgccggccagcgcgccgccggcgacgtggccggtgatgccgccgaacatgctggcgccgaagacgccgccctggatggcgctgtccttgacgtggccccagtccaggctgtcccggttgccctcgcccatctggacgagctggccggccaggtcgccgccgcccatgaagccggcgccgaacgcgacccggctgcccacgtagtgcccgaactccttgcccaggccgaccgtcgcggcctccttgacggcgagcttggtaagcgcgttctcgccgacgtcctcggcgaccttcctgcccacccagttcttcatcagttgctgctggatctctttgaccagctgcttctgcaccgcgcgggcgctctgctgcgcgagcagaccgcggacctcggtgttggccatgtcgcgcagggcctgggcggcgagccggttggcgacggtcttggagatgccacgggcggccaggttggtggcgcccttgatcgccatgtcggtgagccacttgccggcgatcttctcggccaggttgcgggcgccctgggcgaccaggccgcggaccacgccggccgggatcatgtggccgagggtgatccgggtgaccagcgggacggcgaaccggacgccggcggtcagcgcgcgggccgggagcttgccgaacacgaacgccagcggcttgatcgcgaacttcatcacgatgccggcgatccgcccgatggtggcggaggcggccttgcccagcagtgcccggaagccccagaacgccggtggggcgccggtgagcgtggcgccgccggtcgggccggccccggcgatcatcatccagatctgcacggcgagcatgaacaggttcatcgcgacggcgaacttcatcagctcgacctcgagcccgaagttctgcacgccctggcgcatctcgccggcgccctcggcggtctgccggaggctgtccaggtacgcgtaccactgctcgacgaaggcggaggcggacgcgtcgccggaccagttctcgacgatcgggtcggcggcccggacgatgtcctggtacgtccggttcagctcgtcggcgagccgctcccactggtcggcgaggtcgtacacgttgttggcgtgcgccagcgggatctcgccgatcaccaggtgcgagagccagtcggcccagccgggcagccactcctcgaacgccgagaagtagtccagcatcgacgtgatgaactcatgatcgtcactcacgggtcggtccggcagagcctcagacgcgcttcgccgtcgccgtgtgtttcacgatgtcgccggcgttctccaggtcggtcacgtcgtagttcaccatcgccttgccgacgtactcgccgacctcctggagccgggcggcgaccgcctcggcgccctgcatcagcgcctcgttggccgggatgtcctgtcccggcaccggcccgggaaccggcttcttgtagttcttcggcacgaagccgtcggtgaacttgtccgacgggaaggtgtccccgcggttctcgtgctcgacgatgtcgagcttgatggcgcgcacgttcgcggtgagcgagatcccgtggtcgcggagccggtcggcgacgttgatgagttcggacgggctcgacttgatcgagacgtagttacccattagtcatcctctgcccggatcagcacgtcggcgtcgtggctgccgacatagctccgcacgtcgtcgggggccatccggcgcagatcggccggaaggctgtcggtcatcaccgcggtgctcttgcggccggcatcctcgatggccgcgcgaaccgtctgcacgatgctcgcggagagtgccttcgagttgggctgccggagcacccgggggtcgatgtcgagctcgaggaggtggccgcgcgggccgacgaccgccttgatcaggccgtccggcgagtagccggtgccggtcacctggagcatcctgcgctgcacgttcggcaggtcggaggtggccttgcggaggtcggagagcatgtcgcgcagcacgccccagtcgggtcgtcccggtacgtccgccatcgtcctgcccttcctcccgcgtaccaccgatcatcccgcaccggaccggccgccgggaaccccgtccggggctccccacggccgggccgatcacattccggcggcgatctgctggtcgatctgctgcatccgctccgccgacgcgccgagcttcacgccgacgctggccagcgcggccttgatctcgttggcgccctggttccacttctgccgggcctggtcgcaggcctcgcccgcggaaccctgccagtcagccgcgaacagcgtcgtgaacgccgtgtacagctcggtcagctgatggtccatctgcccctcaaaggtgccgatggccgtcgcgacgtcgttgatctggccgaagttgtaggtgatgctcatgattcgcctctctccgatctcgcgggcggcgctcagccgcgcaggatgctgacgacggaaccgtcgccggtcgacgcggccgcggcccggatgtcgtgggcggcgtcctcgtcgtgcgtgccgtactgcttcgaagcgctgctcatcttgccggccagttcgtcgagcgcgttgacgatcttcgcgagaccctcggtgagctggcccgtcacatcctgcagcgcgttgttcgcgctgccctggaacccgccaccgctgagcccctcgatccgctcccgcagccccgccatgccccgggagatgttctccccggtctcctcacagcgctgggccatcctgttgagctgttcctgcgtggcatggacctgtcccatacccggagttcctgccaaggtggttcaccccgattcttccctgtcggcacactccgtgagcggccggcgaaacgtccatgtgggccccgaaggtagcgatccgcttccgtccggtgctaccccgatgtaccgccttggggccctcccggttcacataagtacattcgaacctacgtatcggcgaaggcgtactctatcgcgtcaccaaatgtcgtaccgggcggctaacctgaccggtgcgcgatcgacgacggggaggcgtgatgggcgacgacaatctgtatccggataccacgaagcagaacacgcatcagccctggctcgacgagcacaccccggtcgacgtcaacctcgacggcctccgggagtatgcgaagctgatgggcaagcagcagacccagctgcaggacgacctgggtcgcctgacccatctgtacgactcgccgttcaaggcgtgggacgggcacgtgctcggcgaggccgcgaacatccgccagcagctgaccaacaacgccggcgagctccaggcgtacatggggtatctggcgcaggccttctacaacatcggctcggccgcgcagacgatcgccgacatctactccgacggcgacgcgaccggtgccgcctcgctcaacgacgtgctgttcgccttcggcgacaagtcgatcccccggccgcacggcctgccccgcaacatcggccgcacctacctggacgcggtgaccgagcaggccaagtccgacccggtcgccatccccggggagaccagcccggagtggggcaacccgaccgtcacgaccctctcgccgtaccagtcgaaggaggtctcggtcggtcccggcgggcagcacatggagaaagtgatcaccagcgtcccgggcagtggggtgaccatcgagacggtcaccatcttcaacgccaaggggcagcagctctccaccaagagcacccgcaccaccacgtcgttcgacgcgtccacgcactcgatcgtcacctccaccgagagcagccaggacggccgggccaccggctcctcggtgaacaccaagacgtatgccggcacccggctggccgacgagaccacggtgaacaagggcgcgaacggtcaggagaccacgaccaccgagaccaagaccgccaccgacgggtccaaggtggagaccaccaccaagccggtcaaggacaagcacggccacatcgtcccggaccagcgcaccaccaccgacgaggtgcacaccgggacggccacgacgagcagcggcacgtccgccccgaccacgaagatctccacggcgtacgacccgatcgcccagcggatggcggccgaccatggctgacggcgactacttcggcgcgaaggccgacccgaattacggatacagcccgtacagcgggcaattgcactacggcaaccacagcatcgacttcgagttcactccggacgcgggtgagggaaatccgctcaccatcgagaccgttgaatggatgatcaacaattcgcatccggaggagatcgcggtcctcggtgatcattggcagaacatgatcacccggctgaaccagtacaagacctttctgcgcgacgagagcaagcagctggaggcggagagctggaagtcgccgaaggcgcgggagatgttcctgcagaagggccccggcgaggcactggcctacctggacgtctggatcgacgcggcgaccaccaacctcaccgccatccgcgccctggagaaggtcgccgccgactcgcgggccaagatcgcccagctgatgaacgagtaccgggccgccctgcacaacgcgcagcacgtcgacctgaagggccagctcagcgagtggttcgacaccagccgggcgctcaacaccacctggggcgacgccaagaagtaccagatccagcagcaggtcggggaggtcgagaagcacttcaacggccgggcgcaggaactcgccgcgctgaccgccaaggcgtactccgactggagcaagacgctgttcagcggcgtcggcccgccgtacaagccgatggacgccgtactcaaccagccgggccacccgccgctgctggccccgccgaacctgcccggtggtggcgcgccgcccccgccaccgccgttgccgccggccgtcccgccgcctccgccaccctcgggagcgaacccgaaaccgcccaccgcgccgggtggtgacctgccgcccgacccgtcgcagggcacccagggcaatccgccgccggctcccggcgcgctgccggcccctccgggtcaactgcccggcggcatgcccggcggcgtgcccggcggccttccgctgttccccggtggcctgagcaaccgcgggctcaccccgcccagcctccggccgggtctgggcgcgcagcgcccggcgctgccgcagtcgccgggcaccagcctgcccaacccggggcagctcacccgcaacgcgttcaaccggcccggtcagccccccggcctgggccagccgcccggccgcacgctgcgccgcggcggccagagcaccggcaaaccgggcagtctgccgccgggccgtcccggcgaccgccggcgcggcgagcaggaccgcgagcacggcacccggctgccgggcggcaccgaggaggccttcggtcacccgccgaacagcatgccgccggtgctgaagaatccgtcgaccgaccggcagcggcggcgcccgggcagcaccgaggagttgcgccccaccgcgcacaccagcggtgacgcctaccgcccggagggcaccgccccgccggtgctgaaccggccgatgcagccgggcatcccgccggcgcagccgtcccgcaggcggcagacgcccggacagcggcagaccaccggcccggcgtggggcgacttcttcggctagctagctagcgggtcgcaggtgtccggcctggaggaggtgccggaggcgctgcgcagccgggccgccgcccgcgccgcggccgcacagcagggccgtcccggcacggtcgctccggagctcagcaagcgccgggtgaccggcgagccggctccggcgcagcgggacgaggacgaggacctgtccggtgtggtcaccgacgagcaggcgttcgaggtgcagaccccgggcggcggcgtggtgaccagccagcgtgaccagccggtctacgagccggagatcaagcgggtgctgggctcctcttgaccaccatcgagccggcggcgcggtcgtgcagcccacgaccgtcgccgtcggcgatcaacgccgggacgagcagcgcgagcagcaccgcccggagcaacccgcggcccagcccgatcgcaccgccgtcgatgagcgagcggcaggcgatccgggtcagccgcatcccgggcgtctgtccgaaaagcccgatgaacacggtgttcaccaggatcagcaggaccaccggcggccacgacgtccggtacgggctggcatacaggccggccaccagcaggcagagaagccagtcgatgagcagagcgagcagccgccgcccgccgccggccggttccggccgggccgtcgcctgcggtacgtcgttcgcggaagctgccacgaccgcggagcctacgcgatagggtccgggggtcggccgctgcgcacacgccgtgcctgatcacccggttacgtaacacggcggaaacaatagggacacgccggggcaactccggacccataacgtcgcgaccagccttgccaggtggcggcgtatgccgcccggtgtcggaaaactgtgccaggaggacgtgtgttcgccaatcccgaggaactcctgcgatacctcaaagacgaggacgtcaagttcgtcgacgtacgtttctgtgacctccccggcgtgatgcagcacttcaacatcccggtggagtcgttcgacgacagtgtggcaaccgacggtctcgccttcgacgggtcctcgatccgcggtttccaggccatccacgagtccgacatgatgctgctgccggacgtcgccaccgcgttcgtcgacccgttccggatccagaagacgctggccctgaacttcttcatccacgacccgttcacccgcgaggcctactcgcgtgacccgcggaacgtggccaagaaggccgaggcgtacctcgcgtcgagcggcatcgccgacaccgcctacttcggcgccgaggccgagttctacatcttcgactcgatccgccacgagacctccgcgcaccaggcgttctactacatcgactcgatcgagggcgcgtggaactccggccgtgaggaggagggcggcaaccgcggttacaagaccgcgttcaagggcggctacttcccggtctccccggtcgaccactacgccgacctgcgcgacgcgatggtccgccgcctggtcgacaccggcttcaccgtggagcgctcgcaccacgaggtcggcaccgccggccagggcgagatcaactacaagttttccacgctgctgcacgccggcgaccagatgcagctgttcaagtacatcatcaagaacaccgcctgggagcacggcaagacggcgaccttcatgccgaagccgctgttcggcgacaacggctccggcatgcacacccaccagagcctgtggctgggcggcgagccgctgttctacgacgagaccggttacgccggcctgtccgacatggcccgctggtacatcggcggcctgctgcaccacgcgccgtcgctgctggccttcaccaacccgacggtcaactcgtaccgccgcctggtccccggctacgaggccccggtcaacctggtctactcgcagcgcaaccgctccgcgtgcacccgcatcccggtcaccggcagcaacccgaaggccaagcgcgtcgagttccgcgtcccggacccgtcgtccaacccgtacctggcgttctccgcccagatgatggccggcctcgacggcatcaagaacaagatcgagcccccggccccgatcgacaaggacctctacgacctcccgccggaggagtggggcagcgtcaagcaggtccccggctccctcgacgccgtcctcaactccctcgaggccgaccacgagttcctcaccgccggcggcgtcttcaccgacgacctcatctccacctggatcgactacaagcgcaccaacgaaatcgacccggtccggctccgcccgaccccgcacgagttcgagatgtactacaacgtctgacgcttgctgaagtggccactcccggtccgggggtggccgcttctctctgtccggtggcgaccgccatccttgttggcggtggcggccggtatctctcttcccggtggacggccgccatccaggatccccggtgtcggggttacggcaaagatcaagatccggaaaccgatgtcgtgcgctgcggccgatatcagatcgccgctcccgccgagggcacctccgggctccgctggccgctacgcgtccagaccgcgaagccctccggcgctacacccgcgggtggtcaccgcaaccctcgtcagcgatccggggcagctcaccgcaccctcggtaagcaaccacgctgcccgtcgtcgagctcgagccaccggctcggcacgtgaccgttacgcgagctgccactcgctctggctgtggcctgacgaggatgaatgaacgccaacaccgcaatatcgccgccgttcatgattcgacagtctgttcctccacaggtcctcaaagacctacagctatcaggaaagctcccgcctcacgtcacccagcaggtatttggtggatgtcatgtatggctcgttgacctgcaccaccctcagccactcttcggcttgctccagatacgttctcgcctgttcgtctccgaactgaccgaaatacttcagcgcgcggcggctgtaactgaaggcgtgcaaggatctccgcctatccgagaggtaacacctacgcagcatatccatagcacggtcggcctgccttcgagcgtccgaactctcggctgccagatttatattggcatcgaagagaagttctgcatgcgtggcttcgatgcgccaattcttcttggggctcatcgcgagcgcctgatcaatagccacgaaagattccgtgtagagactcctttcgctgagcagtagcgccttctgctgaagaaggtatggatttgcatccttatccaggaggaggtcgtagaattggatcgcgtcctgcgtccgctgaaacgcacgcccaatgatccgatgactgtatccacgtctgcgaaagatgtcgaaacggcagattcgggtagtggcgaggttcgaatgaaaggttgtcagcaccttgcgcaggatggacgtccttgcggcattcagggccgcctctgccaccacaatggaccgcgccgcaaagtaatcctgcccatcatcttccgccaggtcgccctcatactcattgaggagctttccgactttttcgatgagtgttaatatgtctctgtattgagcggatttatcacgccaataggcgagtgccatgtccattgacaacacggttccgcatgcatgaacgtatgcgatcaagataagcatctcggcagagaccggatcatcttcctggaactgcttgatggcctctacaaggcgcgattctagactcttcgaggtagtattcgcaaggttgaagtccagtatgctcacctcgcccgcggtaaccggcggcctaaccatcttcggggtccgcacggccgcaggtatggcggctcggatggtgccctgatccagttcactgatttcagacagggaaacgaattccacaccagaccgatcgatacggtggatcacggtcccgatgttatagtcacgatcagcggcgaggagcgtaatattcggcgccgctcggagcagattccatgcctcgacgtcgtcacagaagcgatcgagtaccacagtcgcttcgttcccctgcagaacccgttgaagtcggtccgcagcctctctggtcatggagcctggcatgaaagtaacgccaggacctacattcgccgccgcgagttgcatcaagagcgtcgttttcccgctcgccggaattccagtgacgattacgtcctttttgctgttcagcgcattctccgccactcgatactgttccaatttcggaacgtctgggcgaaatatgtcactccatgccggcgccgcaccggaatagaattccactacggggcgctgaggcaccctactaggccttggaaccaaatattgcctcagcgagtcgatgatgtcatccgcgccttccgacggtgccgccggaaccaaaccatcgaaatattcgatcatttcttcagtttcagcgaagatgatctgaaaacgtagagcgcgaagatactcgacaagggggtcgtctcggtcggacggcctgaccgtaatccaattgttccctacggctcttccgccctgacccgtggtctgcagggattcaagagccgccgcgtcctgcagagagtatccccaaaacagtgtcgggcccgccgacagccgacgtcgaaaggtctgccagagcgtaggatccgacgagaagctgctggccacctctatgctcgtgaagcgaaatgctcgcgtatcgtcgagtacggaaccatggagaggggcatagtcaaccgccgatccatccttaaactgtggcccacgcatcacgacgtcattgagatatttcgtctggctgccttcatagatcttccatggcaggtcgtcgatatttgtggtaaaaatcatcgaaacgttaaggcgcgccacagaggtgtagcgcggatcaaaccagccgaccgtgaaacgattccggagatattcgtcggcggcgtcccgatccttcgccgccagaatggtgtaaagctgcggcagggtcagcttgcatccaggatccacgccgaattcttgacgcaattcgtcgccgagcttcccgccgacaggaagagaccttccctgcttgtccttcgccagcacgctgaagccggctcccagcatcaggtgtataccggcctgcagagccacctcgaatgaggcagagttctcgatgtccattcgccgaccttctctgagaagtcgcgtgaggttcaaggtctaccacgcgtcgagcgtagaagcactccatgacaccttcgatatcctgaaagggggcgcaaaggggctgatatcaatccctgctctcgcccgcacgctatgaagtcgcgaagccgccatcgaacgcctactcctctcgacggttgacgtgcggggcgtcaagcaaggagacgctcgccgaaggacccatcgagcgctgcgccacagtggaccatgggccgagcggccagcgggacgatgcggaaccgcgggtgcggtcggcgaggcagaatcgacgcgtggacatcggggtgctgggcccgctggagctgcgcgccgatgacggtgcgccggtgccgatcggtggcgtccgactgcggacgctgctgattcttctcgctcgtgacgcggggcgcagcgtctccacgggccggctggtcgacggtctgtggggtgcggcgccgccggccggcgcggggaacgcggtgcaggcgctggtgtcgcggttgcggcgggcggcgccggggttgcggatcgaggcgacggcgaccggctaccggctggtgctggatccggggcgggtggacgcgctgcgtttcctggcgtgcgccgaccgggatccgggggcggcactgcggatgtggcgcggggagctggaggttcccgacgtccatctggaggaggtccggctgcgcgcgcagaaggcctggctggcggccgagatggcgcaccgcgacgtggtcgccgagctggaggccctggtcgccgcgcacccgctggacgagccgctggccgcgctgctgatccgggctttgcgtcgggccgggagtccggggcgggcgctggacgcgttcgagcggatccgggtccggctccgtgagcagctgggcaccgacccgtccgccgagttgaccgcgctgcaccgggagttgctccgccaggagcggccgggcccgcgcgggaatctgccggccgagctgagcaccttcgtcggccgggagaccgacgtccggcgggtggtcgcgctgatcggcacgcatcggctggtcacgctgaccgggccgggcggcagcgggaagacgcggctgtcggtcgaggtgggcggccggctgccgggtgcgtcgtggctggtggagcttgcgccggtacgggacgccgcggagctgccgcaggccgtcctgaccgccctgggcctgcgggagcagccgggccgtgatccgctgacccggttgcgggacgcggtggccggccgggagctgctgctgatcgtggacaactgtgagcatctgatcgaggccgccgccgaggtcgccgcggcgctgctgcgggccgcgcccgggttgcggctactggcgacgagccgggagccgctcgggatcccgggcgagggcatccatccggtggagccgctgccgttgccgccggccgggtcggacgccaccaccgcggccggctttccgagtgtgcggctgctgctggaccgggcgaccgggttcgcgctgaccgacgggaacgtggcgagcgtggtgcggatctgccgggccctggacgggatgccgctggcgatcgagctggccgcggcccggctgcggacgctgccgccggcgatgctggcggaccggctgaccgaccggttccggctgctgaccggcggtaaccgggccgcgctgccgcgtcatcggacgctgcgggcggtggtcgactggagctgggagctgctgtccgagccggagcgccggctgtggcggcgggtggccgcgctgcccggcggcgccgacctggcgggcgtcgagcgggtttgcggtgccgacctggacgtggtcagcgcgctggtggacaagtcgctgctgatcctggagccggacgggcgctaccggatgttggagacgattcgggagtacggcctggagcggctcgccgaggccggcgagaccgagtcgtcgcgccggtccatcgccgatcatctgctggcgctggcccgggcggcggagccgcatctgcggcgggccgagcagctggtctggatggcccggctgcgggccgagcacgacaatctgcacgcctcgctgcgggccgcgctggcggccggcgaccgggccaccgcggtcgccctggtggcgaacctgggctggtactggtggctgtgcgggcaccggaccgagggttccacgctgtgcctggcggcgctggccctggacggcccggcggaccggcaggagctggccctggcgtacaccctggcggcgctcaacggggtcgagggcccgatggcgttcgccgaggtgaaggcatctttcaaccgggcgctggagctggccgacccgcatccgggcagccatccggggctgcggatgctggggctggtcgcggcgctgtacgggacccggcgggcggatgcggagcaggccgccgcgacgatcgtcgacgacccggatccgtggctgcgcgcggtcgcccggatgatcgtcgggcaggtgcggctgaatttcggggagccggccgaggtcgccgaggcggacctgcgggcgtcgctggccgggttccgggcggtcggcgaccgctggggtatcgggttcacgctgagcgcactggccgacctgaccgcagcacgcggcgacttcgcgcaggcggtcggctggcagcgggaggcggtcgagctgctgcgggaggtcgggatccgggaggacgtcccgcagatgggcgccaagctggcctatcagctgtggctgcacgggcagcgggagcaggcgtaccgggcgttggacgaggcccgggagtacgccgccgacctcggcattccggaggtgatggcgtcggtgcaccacgtgtccgcgacgctcgcccgcgaggagggccggctggacgaggcgcgcgagcaggtggaccggaccgtggcactgatcgccggttcgacgctggcgccgcagttccgggcgatgacgcacagcacccgggggctgatcgaggcgaccgccggccggctcgccgaggcgcgggccgagcacgagaccgcgctgcggatcgcggtgcgcacccgggattcgccgatgatcgcccaggtgctcgccgggtgggccgacctggcgctgcgcgaggcggatccggagcgggcggcgttcctgctgggtgccgctgacgcggtgcgggggtcggtcgaccgtaccgtcaatgcgggtgtgatcgtggcgggcgaagcccgcgccgcactgggcgacgcgggctatgcggcggcgttcggccgggccacggcggtcaccatggacaccgcgctggccgcggccggattagacccggcggcggaaggcctggacggagaggggggcgaagaccgcgaagagcgcggcggcccagatcagcgcaccggtgaccgggccggccaccgggccaccggtgagcaggccgcggccggcgtcggccaggagcgtggtcgggttcacccccgcgaagccgcgcagccagcccggcatgctgtcggtgcggacgaacgcgctgctcacgaacgtgatcgggaagatcagcacgaagccgaagatctgcacccgggccggttcgctgaccagcatcgcgagcagcacggacacccaggagacggacaccgcgaagccgagcagcagggcgaagaagccgagcaccggcagcgggccggtggtgatccggaaacccagcagcatgccgaaacccagcagcagcgcgagcgcccacgcctgtttgatcacgtcggccacgatccggccggccagcggcgagaaccgggagatcggcagtgaccgcagtcggtcgaagacacccttgctgatgtcggtgttcaggccgacgccggtggtcaggctggcgaagagcaggttctgcgcgatgatcccgggcagcgcgaaagccaggtactcctgcggggagccggccatctgcccgccgaagacataggtgaacagcagcaggaacatcaccggctggatgctgaagtccatcagctcgaacgggttgtgccggatctgcaccagcgtccgccaggccagcgtcgcggtgtggcgcagggtcgtcgtgctcatgcggcggctccggtcaggctcaggaagacctcgtccaggctcgggccgcgcagcgccagctcggacaccgggaggccggcgtcgtccaggctccggaccagcgcggtcagcgcccccgggccgctgaccggcgcgaccaccgcatcgccgcgcacctcgaccggcccggccgcgacccggcccacctcgccggacagtttctccagatcatccgggtcggccggacgcaccgtcacggtctgtgccccggtccgggccttgagctgctcgggcgtgccggtggcgagcacccggccgtggccgaccaccacgatctcgtcggccagccggtcggcctcctccagatactgggtggtgagcagcaccgtggtgccgtcggcgaccagcccccggacgatgtcccacacctcgttgcggctgtgcgggtccagcccggtggtcggctcgtcgaggtagagcaggcgcggctcgccgaccaggctggccgccaggtccaggcggcggcgcatgccaccggagtacttcccggccgcccggccggccgcgtcggccaggtcgaagcggtccagcagctgcccggcccgggcccgggccgccggccgggtgagcccgagcaggcggccgatcatcagcaggttctcgaaaccggtgagctgctcgtcgaccgaggcgtactggccggtcaggccgatcagccggcgcacctggtggccctggcggaccacgtcgaagccgcccaccgtggcgtgcccggcgtccgggcggaccagggtggccagtacccggaccgcggtggtcttgccggcgccgttcgggccgagcagccccagcacggtgccggtgcggaccgcgaggtccaccccggccagcgcggtggtgtcgccgtagcgtttcaccaggccctcggcgtagacggcggtggtggtgtcatgtcccatgcggccaccgtgccggggaccgctgacaatccgctgacgcggtgatcagcgcccgtcagcgccggtcagcaccttctccggagccggatccggggccgggaccccggcgccgatcggcgtccagatcagcagagccaggctgaacaggacgtagaggttgctgcccaggatcgccatcggcggccacggccggttctcccacagccaggccagatgcgaggtcatcagcacgtacgcggcggtggccagccaggccggcccgcgacccacccccgaccagccacgctccaggcagcggatcagcgccgggatcagccacacgcagtggtggatccaggtgaccgggctgaccaggcagcccagcacgccggtcagggccaggccgccgaccacgtcacccgggttccgggccacccgcagcccccaccagaccagcgtgatcaggacgcagaccagccagatcttcgagccgatctggtcgtacggcagtcgggcgatcatgccgcgctccgactggttggagaggaactgcagcgaacccacccggttggtgtcccacagcgcggacgtccagaactcccgggactgatccgggaacagcgcgccggccagcaccgacgccccggcggccgcgccgatcgcggtgcccgcctctttccaccggcgggtcaccagcagatacaggatgaagactccgggcgtcagcttgatcgcggtggccagcccgatgccgatgccaccccaccagcggccgcgggcgaccccgaacagcatgtcgccggtcaccacggtcagcagcagcagattgacctgaccgaaactgaacgtctcccggaccggttcgaaagccagcccggcacagcaggccagcccgaagacgaaccacagcgggtggccggtgcggcgtagcaccgacccggccagccaccagaccagcagcgcggtggtgagcaccgtgccgatcgaggcgagcaccaccacggcggcgaacggcagcaccgacatcggcgacatcaccaggccggcgaacggcggataggtgaagccgtacggcgtgcccggcttcagccagtcgtagaccatcccgccgtcgcggaaccagtacttcaccgccccgtagtagaccttggagtcgaagaactggttacggtgcaccgcggtgaatatcagaaccaccgccagcaacgccgacccgaccagggacacgattcgcttcatgcagcactttccacgctagagaaccggcgagcacagtcatcccgacagcacccagagccttggtggccagggcgaggttgtatccgtcgggcaggcagagggcggcggccaccgcgcacgggacggccagccaccgggtgtcccggggcagcgtggcggccagcacggcgagcggccaggtcgcgtaccacgggtggaagaccggggcgagcagcaccgtcgcggccagcgccagcccggcgtacaacagcggatcgccgcctcgcgcggtccgccggaacagggcgatcagcacggcgaccagggccagcatgccgaggatccgggtgaccgggacgccgtgcggcacgccgaacagctccagggtcatcccggccgcggtcggcggcgacgtccactgcaccgacacgccgctgtccacgagcgcgccgatccagcccaggcccagcccggagccgagcgaggcgacgagcagcgcgccggccgcgcccccggccaactcgccggccgcccgccagcgcggcttcggcaccaggaagatcaggaagggcagcacgacgatcgcggtgaccttcacccccaccgcgagcccgatcagcacaccggccggccagccccggccggtcgaggcgaccgccaggccggcgaccagcagcgcgaccatcaccgcgtcattgtgcgcgccggacaccaggtggatgagcagcaacggacaggccagcaccagccagaccgcgcgagcggccggcacaccggcccggcgggccagcaccggcaggcaggcacccagcagtgcgaccccggccacggcgatcaggcggagcagcgccaccgtcccggccagcgaaccgccctcccgcgccgccatggcggcgagggtcaggaacaccgggccgtacggggcgggggtggcgcgccagatcggcgcgacggcgtcggaccacgggcaacccagaagatcgaccccgccggcgtacgggttgagcccggccgcgtgctgccagccctggcaggcgtacgagtaggtgtcgtaactgcccagcggcaggaacagcaccagcgggaacgcccacagcccggccgtgacgaacgcccaccgcgcggacgggaccacccgtcgcccggccagccaggcgccgatcagcagggtgatcccgatcagccagaacaccggcagcaggattccgttctgcccggtgacgatcgtccacggggtcaccgtcggttcccacgggcggtgcgcgccgccgagccgcgcggcacctgacaacagggtgctacctgcgagccccgcatatcggatgagaggcggacgcggcatggcgacgaccctaccgtgacagcctgcaacgtatggggcccccggtccgcggcgccgggtcgggtcgggtcggatgtgattcggactgcgcccaccagcggatagggaagggcgcggggatcgtggtggacgcgccggcggccgggtcgccgggaccgctcgcccccgatcagcggcgatcagtcatcgaccggcgcgcccgacatcacgaggttgaaggtgaccgtcagcgggcccccgcacgccgggcccgcttgagttcgcgctggtcgcgagtgtattgcttgcggcgttccaggtccgccttccagccctcgcgggcgaaggcgtcgcagccctggacggcgcccttcgtctgggccgggccgatcagcgagcggaaccacatgtcgtcgaaggtctcgtggaaccatcgcgcgaaccggtcctggaacgtcgccacgacgcactcctcgtctagttggcgggccaactgtttgtgccccaactattggtaggataaccaacgacctgaggagaaccgcaagtgaccgacgacgcccccgtggatgatgatccgctggctctggaacgacaggtgtgcttcgcgctgtcggtggcggcacgcagcgtcgtggcgctctatcggccgctgctggagccgatgggcctgacgcatccgcaatatctggtgatgctcgcgctctggggggagtcgccgctgaccgtgcgccggctcagcgagctgctcgcgctcgatccgggcacgctgtcgccgctgctcaagcgtctggaagcgatcggttacctgcgccgtgagcgggaccgggcggacgagcgcagcctggcgatcacgctgaccgagcggggtgaggcgctgcgggccgaggcgttgcggatcccgccggccgtggtggcacggctcggcatgccgatcgacgacctgcaccggctgcacgcctcgctgacccgggtgatcgccgcggcggtgtgagcggtcaggagaagacccgttccatggcggcccgggaccgccgggtgaggcgcaggtagcggtcgacgaactcgcccgggtcaccgccgccgagcagcagcaccgtgccggccagctcgacgccgtgctgcggcagctgatcggtcgggcggccgcggaccagggtgagcgcgttgcggacctgggcggccagcgtccagccgtcggccatcgcggcggcgtcggccgcctccaccaggccggcctcccgggctgccgccagcgcctccagggtcgcggtgcggcgcagatccggcacctcgtgggcgtgccgcaactgcagcaactggaccgcccactcgacgtcggccaggccgccgcggcccagcttggtgtgcgtgttcgggtcggcgccgcggggcagccgctcggtctcgacccgggccttgatccggcggatctcgacgacctggtcccggctcaagccgccgtccgggtaccgcttgcggtcggcgagcgcctcgaacgccacgccgagatcgtggtcaccgcagacgaagcgggcgcgcagcagcgcctgcgcctcccacaccttcgaccagcggtcgtagtactgctggtaggcctgcaggctgcggaccagcgggccctgccggccctccgggcgcagatcggcgtcgacgcccagcgccggatcgggggcgggggcgttgagcagccggcgcgtctcctcggcgaccgcgtgcgccgcggcgccgtcatccgtgccgtcgaagacgaacagcacgtcggcgtccgacggatagctcatctcgtagccgcccagccggcccatcccgatgatcgcgaaacgcatcccgggcggacccggtcgggcccgccgggcgatcagcagggcggcgttcagcgtggcgtcggtgaccgcggacagcgccgcgccgatctcgtgcacgtcgaccgggtgggccggggccagatcaccggcctgggacaggatgtccgcgcaggccagccggaacagctcacggcggcgcagggcgcggaccgcggcgatcgccttgaccgggtccccggcgtgccggtccgccgcggcggcgaacccgtcgagcagcttctcccgggaccggggctgcagctcggcatcgtcggccagcagccgcaacgcctccgggtcgcgggtgagcagatcggtggcataccgggagaggccgatcacccgggccagccggcgggcgaccgggccgccgtcgcgcagcagccgcagataccacggggtgccgcccagcttgtccgacacctgccggtagttgagcaggccccggtccggctccggcgcgtcggcgaaatcctgcagcagcatcggcagcagggtgcgctggatcgccgaggtgcgggtcacgccgccggtcagcgcctccaggtggcgcagcgcgccggccgggtcggcgaaaccgaggatctccagccgcttgcgggccgactccggggtcatccgcagcgcgtcggccggcacccgggccaccgcctccagcagcggctggtagagcagcttgacgtgcagccggcggacgttcgcggcgtgcccgatccagtccgaccggaacgcctccaccgcgccttggccgggcagcgcggtgtagccgagcgccgcggccagccagcgcagcccggccggatcgtccggaacggtgtgcgtgcgcttcaggtgctgcaactgcagccggtgctcgacggcccgcaggaaacggtagccgcgcagcagcgtctcaccgtcctgccggcccacatagcccccggagaccagggcccgcagcgccggcagcgtgccgggcagccgcagcgactcgtcgacccggccgtgcaccagctgcagcaactgcaccgcgaactcgatgtcccgcagcccgcccgggccccgcttgatctcccggtccagctcgcgggccggcacgttgtcgatgatccggcggcgcatgtcccgcacgtcggcgaccgcctcgggccgctccgcggcatgccagaccagcggcgccagatcggccagccactccccggccagcgccaggtcgccggccgccgggcgggccttgagcagggcctggaactcccaggtccgcgcccacctgcggtagtaggcctgatggctggcgagggtgcggaccagcgggccacggctgccctccgggcgcagcgcggcgtccaccggccaggcgacctgaccgcagatctccatcagccgggccgcgaccgtggtgccggccggcagatcctcgtcgccggccgccacgaagatcacgtcgacgtcggagatgtagttcagctcgttgccgccgcacttgcccatcgccaccaccgccagacgcggctccggggtgccggccggcagcgcggccaccgcgatcgcgtacgccgcggacagcgtctcgtcggccagcgtcgacagcgcggccatggtcggctccagaccgcggccaccggtcaggtcggcggcggcgatccgcagcagggcgatccggtacgcccggcgcaacgccggcacggtcggctcgtccagctccaggtgcccctccggatcgggcggcagcccgctcttcgtcgtggccagcgcccgccactcctgctcgttggcgaccaggtgatcgccgagcgtcgacgaggcaccgagcaccgccaccagccggcggcgcagaccgtgatcccggaacagctcgccgaacacctcccgggtggcgtcgttcgcggtgatctcaccggtcggcccggtcgggcgggccccggcggcccgctcggcggcccgggacaccgcgtcgaccagccggtggaactggcgcagcgccagatccgggtcggcggcccgggacagggcgtggatcagctcggccgcgtcggcgccggccggaccctcggcgtcccacagccgcagaccgcgcgggccgagcagatcggccccggagtcggcgaaaccgtaccgcgccagccgggtggggcgggtcacctcactgccccagcagcggcagggtcttcggcatcccggcatccggcagctgacccagggccagcgcggcgaaccgggccgcgaacggctgccagacctcctcgacgtcgggcaggatgccggcgaccgcgtgcaccaccgcctccccgtcgtagcccagctcgtccaggtcggcggcgcccagccggacccagtcggccatcatcgcggcgtcacactcgatgtggaactgcaggccccaggcccggtcgccgatccggaacgcctgatgcgggtaacggctggaggcggccagcagggtggcgctcagcggcagctcggtgatctcgtcacggtgccactggatcacgtcgggcagcagcggcacccactggaacagcgggtcggtgtcggccgcgtcgcgcttgccgaccagccccggaccgatctccgggccggccggactgcgctccaccagaccgccgtgcgcgctggccagcagctgcccgccgaggcacacgccgagcgtcggcacccggttgcggaccgccttgcggaacagcccctccaacgccgggaaccagggggcgcccggggcgccggccgcatccggataggcgctctgatcgccgccgagcacgatcagggcggcgaagtcgtccagggtctcgggcagatcgtcgccggcgtgcgggcgcagcacggtcagctccagcccggcctcggtgagccactccccgaggcgccggaggtcgtcggtcggatcgttctcgatgacaagcgctgtcctcacgtgacgaggctaacgaattactcgccggcaaacaccgacaggacgctgtcgggccggcccgcgagagttctgtcgacgccaacgaaggagaacgagatgaacaccatcggctggatcgaagtcggcaccgaccacccggcggaggccgagaagttctacggggagctgttcggctggaccttcaccgacgacgacacgtccatcggactggacggcgaggcgtaccggatggtcaccgggccggacggcggggcgccgttcggcggcttctacggcaccggggggaaggcgccgcagcaggcgatcttcctggtggtggtggccgacaccgaggcggtctgccgtcaggccgtggccggcggggcgacagtcctggtggggccgcagcgggaagccaacgggctggtcttcgcccggctcgccgacccgctcggcaacctcttcggcgtcttcaccccgccggctccgcggtcctgacgagcagggtgagccgctcccgccgggtcaccgggatgtccagatcatcctcggtgaacgggcgggccggcgcgacctcccgggtcggcaccaccgagctgatccggtcggtgcggaagatccggacgccgtcgcgcagtcggcaccaggcgatcagataccactggtcgcggatgccgacatatcccaacggctcgatgtcgcgggtggtgacggcgccggaccggtcggcataaccgatccgcaggacccggccgatcggcagcgcgccgaccgccgcgcggggcatgacggccgggacgatcccaccgaccaggtggatccgctcggccagctcctgcgcggcggccgcgtcgtcggtccgcatcgccgcgaccagcttgcggaaggcgctcgccgccggctgccggaacggggtgccgtcgagccggcgcagggccagcgccatcgccaccgcctcctccggagtcaggttgaccgggggcagggtgtgcgcccggtccaggcagtaaccgccggtgcggcccggctcggcgtagatcggggtgccggactgctgcagggcgccgatgtcacgctcgacggtgcggacgctcacctcgaagcgctgggcgagccagcgggcgctgcgtggccggggtgcgaccgcccgcaattcctcgacaagggcgtagagccggtcggtacggttcacgcccagcacgctagagcgggggtacgacaatctcccggtacggcgccggcaccccgcagtcaccgccgaccgcctaaggtctgcagcatgacgcaggagtcgcccgagccccgggtgtccacactcgagctgttcttcgatctcgtcttcgtcttcacggtgacccagctcgccgactcgctcgcccaccacccgacctggtccggcctggtcgacgtcctgttggtcctggtcgtcgtctggtggatgtattcggggtatgcgtggctcaccaacgcggtcgccccgaccaccaccacccggcgcaccctgctgctggccgggatggcggggttcctggtgatggcgctggccatcccggacgcgttcgggcacaacggctggctgttcggggtggcctacgtggtcgtcaacgtcacccattcggtgctgttcctgcaggccgggccggacgcgcggcgggtgatgcggactctcgggccgatgaacctgctggccgcgctgctcgtgctgaccggcggggtgctgcccgagccgtggcggcacctgtgctggctggccgccccggtggtgcaggtgctggcgagctactcgcacccgatcgggctgcaccacatcgcggccggccacttcgtcgagcgccacagcctcgtcatgatcatcgcgatcggcgagtcggtcatcgcgatcggcgtcggtgtcggcggccagggccatctcggcggcgacctgatcctggccgcggttctcggcctggccatcgcctactacctgtggtggacctatttcgccgacggcgaccgccgctccgagcacgtcctggccgcggtcgacgatcccgcccggcgcggccgcctggccctgaacgcctgggggtacgcgcacatcccgatgctcctcggcatcgtgatcaccgcggtcgggatcaagaagacactcggccacacgttcgaggcactgcactggccggaggccctgatgctgggcggcggcgtcgccgtctacctgctcggtcacgccgtcttcctgcgcctgctggcccagcccggcccgggctaccgcgtgatcgtggccacatgttgcctggccaccgtcccgctggggcacctcctggccgtcgcccagctggccgccgtcgcggtgatcctggcggccggcgccatcgccgaggacatcccccgcgtccgccgcgccggattgcaggccgccatcggcgacttcggccgcaccggctgatccccacgcccgatccgctcgcggtacccggagtcgcgccgtggccccggacgtttccgctgaggcgcggggtcccatcaccgcatgaccccatgtgcgggatcagcccggtgcgtccggccgggagaaccgctcccggcacggcggatcgggtttcaagcgatgcaggcgcagacgatgagggcggcgccgaagtgggaggcggcgctgaccagggcgccgccgtggaagtcgtcggtgcagatgacttcgccgagtctgccgggggtcatccagtcgaggaccaggaaggccaagcccatgatcgcgatgccgatcaggccgaacaggaccgtggaggcgaggccctggccgaaggagtcgtaggtggtgaagatcgcggtgaagacgatcgcggcgatgccgagctggttggcggccaggagcagggaggcgttcgggttgcgccgggtccagatcaggtcacgcagcttgcccggcgtgagcaggtcgatcagcacgtaaccgacggccatcaggccgatcccgatcaggccgaagacgatgctccgccccgcgccttccagcaggtcctgcagcacagccacttcccccttgtcgcatgacgtcagagcagaccgtaccccgtgtgacgagacttcgggaggcggcggcagtccggaccggccgtcaccccggcggaagcggcgacccgggggagatcagccgcccggccgggcgatcaaccccggcgagggcggcgaccagggaagaccgccgccccggggtcgggacggtcagagggcgccgaggtagcgctgccgctcgtagggcgtcacctcacgccggaactgctcccactcggcgcgcttgttgcgcaggaagaagtcgaagacgtgctcgccgagcacctcggcgaccagctccgacccggccatcacgtcgatcgcctcggacaggttctccggcagcgcctcgtagccggccgccctgcgctcggccggggacagcgaccacacgtcgtcctcggcgccggcgggcagctcgtaaccctcttcgatgcccttgagaccggccccgagcatgaccgcgaaggccaggtacgggttggtcgccgagtcgagcgagcggacctcgacccgggccgagttgggtttgccgaaggccggcacccggaccagggcggaccggttgaggtggccccagctgacgaacgccggcgactcggtgatccggtcgggcagctgcatcgggaacagccgcttgtacgagttgacccactggttggtgaccgcggtgtactcccgggcgtgcaccagcaggccggcgatgaacgcgcgcgccgtcttggacagcttctgcgggtcctcgctgtcgtagaacgcgttgcgctcgccctcgaacagcgacaggtgggtgtgcatccccgagccgggctggtcggtgtacggcttcggcatgaaggtggctttcaccccctgggagagcgccacctccttgaccacgtgccggaacgtcatgatgttgtccgcggtggtcagcgcatccgcgtaccgcaggtcgatctcctgctggccgggggcgacctcgtggtggctgaactcgacggagatgccgatccgttccagggcgagcaccgcttggcggcggaagtcgcgggccaccgcgtgggtggtgtggtcgaagtagccgccggtgtcgaccgggatcggcaccgagccgtcgttgtcctggtcctggatgaggaagaactcgacctcggggtgggtgtagaaggtgaagcccttctcggccgcccgggccagggcgcggcgcagcacgtggcgcgggtcggcccaggcggggttgccgtcgggcagcaggatgtcgcagaacatccgggcgctctcgccgctgccgccgccctcgaacgggaagacctggaaggtggtcgggtcgggcatggcgaccatgtcggactcgaacacccgggcgaagccctcgatggcggagccgtcgatgccgatgccctcttcgaaggcggactccagctcggccggggccaccgacacgcttttcagcgtgccgaggacatcggtgaaccagagacggacaaaacggatgtcgcgctcctcgagcgtgcgaagcacgaactcctgctgtcggtccacgtccacccctcgccccgctgtcaacccgtcgagccgagactacgctgaccttgccctgtgacgtcggcccgggtcgaactccgggacgcctccgctggggaagaatgaggcgcatgcccacgctgcgcatcgccctcgctcaggtgaattcgacggtcggcgacctggccggtaacgcggccgcggtccgccgctggtcacgggccgccgcggaggccggcgcgcacctggtggccttcccggagatgatgttgaccggctatccgatcgaggatctggtgttccgcaactcgttcgtcgaggcgtcccgacgggcgctgggcgagctggccgcggagctggccgccgacgggctgggcgagctggcggtggtggtgggttatgtggacgccgacgggccggcccggatcagctcggacgccacgccggggaccgggcgccgcgacgcgtccgcgctgctgcaccgcggcgaggtggtcgcgacctacttcaagcaccatctgccgaactacggcgtcttcgacgaggaccggtatttcgagcccggtgacacgctgaccgtggtgcgcctcaaccggatcgacatcgcgctcaccgtctgcgaggacatctggcaggccggcggcccgttcaccgcggcgcgccgggccggtgtggggctggtcgtcaccatcaacgcctcgccgtacgagttgaacaaggacgacgtccgcctcccgctggtgcagcggcgggcggccgaggcgggcgccaccgtcgcgtacgtcaatctggtcggcggtcaggacgagctggtcttcgacggtgactcgatgatcgtcggaccggacggcgagctgctggcgcgggccgggcagttcagcgaggaactgctcgtccacgacctcgatctgccggaggcggacgccgagccgaatccggagggttccaccgacgcggcgaagccccgggtggaaaccgaggtgagcgacaccatggcggtaagtcggacgacgatcaccggcgagccggccatgctccgcgaccgccggacggcccccgccaaggatcgcctcgaggactccgccgagatctggtccgctctcgtcctcggtctccgggattacgtcgacaagaacggcttccgctcggtgatcctcggtctctccggcggcatcgactccgccgtggtcgccgcgatcgccgtcgacgccctcggcccggaccgggtcaccggcgtctcgctgcccagcggctactcctccgagcactccaaggacgacgccgccgacctggccggccgcaccggcctgaaataccgcgtcgagccgatccagccgatggtcgacgccttcctggcgaacatgtcgctgtccggtgtcgccgtggagaatctgcaggcccgggtccgcggcgtgatcctgatggcactctccaactccgacggccacctcgtgctcaccaccggcaacaagagtgagctcgcggtcggctactccacgctctacggcgattcggtgggcggcttcaaccccctcaaggacgtaccgaagaccatggtgtggcaattggcccgctggcggaacacgcaggcggacgcaccgatcccggagaattcgatcagcaagccgccgagcgccgagctgcgcccggatcagaaggattcggattcactgcccgactacgaggtgcttgatccgatcatcaaggggtatgtcgaccacgacctcgggcgcgccgagctgatcgcggccgggaacgacccggccctggtcgaccgggtgctgcggatggtcgacctggccgagtacaaacgccgccaggccgccccgggcaccaagatctccgggaaggcgttcgggcgggaccgccggctgccgatcaccaacaggttccgggagggacaggtactttaatccgtttcccgggtggtgagcggggcggtgggatggtgtgaaaacctccactgacccctgaccgaggtcctttccccggtgcgacgatgctcgcaacacccggggaccgcatcaggcggcctcgagggaggagagtgacgacatgtcggagatcccgaccctgtacggcggtcccgcaacccgccgggtccgcacccgtgacctgctcaacgccaaggtccgcggcgaccggtggccgatgctcacgtcgtacgacatgtacaccgcttcgatcttcgatcagtccggtgtgccggtgctgctcgtcggcgattccgcggcgaacaacgtgttcggatacgagaccaccgtcccgatcaccgtcgacgaactgttgccgctggtccgcgccgtggtgcgggccaccaggaccgcgctgatcgtcggtgacctgccgttcggcagctacgaggagtcacccacacaggcgctgcgcaccgccgtccggttcatgaaggagggcggctgccacgcggtgaagctggagggcggccgccggatggccccgcagatcgaggcgatcaccggtgccggcatcccggtgatggcgcacatcggcttcaccccgcagcgcgagcacgcgatcggcggctaccgcgtgcagggccgggagaacgagggcgccgaggtgatctcggacgcgcgggcggtcgccgacgcgggcgccttcgcggtcgtcctggagatggttccgggcgaggtcgccaagcaggtcaccaaggagttgtcgattcccacggtcgggatcggcgcgggcccggacaccgacgcccaggtgctggtctggcaggacatggccgggctgcggaccggcaaggcgccgcggttcgtcaaacgctacgccgacctggcgggcgcgctgaccgaggccacgcggcagttcgccgacgaggtccgctccggcgagttccccgctccggagcacaccttctgaacccgttgtcgagtacgccgtgagcaccgccgccgcgcgcgacgctccccaggagctcgcgcgcggcgcccggcccgctcccggcggtccccgccgttgcggtctccggccggtccggcttctccggcggcggccgtacgaatgtctccggtcacgccttctcgaagcggaccgtgcgggtcgacgggtcggcctcggtgagccgcgcctggatgcgtgagcccagcggcaggtcgccgaggcagcgggcgcgcacggccggctcgtcgagcgccaccatgccgccggccggccgtttcccggaggcgtcctcccggtccaggaccgccacgtcgaacgtctccccgacccggccctgcagcagcaccgcctcggccaggtcgatcgcaccccggtcggcggcgccggcgacccggtcggtcgcggacatctgcttcggcagccggggcagcgcctcccgcacccacccgggcaccgggcggcccccgtgcagggccaggcacgcctccgtcacgtaccggtcggcaagcctccgcagcggtgccgtgacgtgcgcgtacgccgcgcccaccccgccgtgcccgacgtcggacggcggcggcccggcgtccccgccgaaggcggtgtacccggcaccgcgcagcagctccgccgcctggtcgagaaacgccgcgccccgcgggctgcccggatccaccgacgccaccaccgcgccgacgctcgccccgtccggccagggcaccccgagggacgcggcggcgacccgcagaccggccaccgcctccggtttcggcgccggcatggtccgcagcagcccgatcccgccgtccagcatgatccgcgccgcggccatcccggtgagcagcgagatctgcgcgttgtgctcctccaccggcagcggcgcgcgcagcaccagccgccagccgtcgccgtcgcgctccacctcctgagccggcagcggcagattgaccgctccccggtcggcggcccggcgggccaaccgcgcgccgatctcggcgagcagcgtcacctgctcggacgggctgccgccgtcaagctcccgctgcacgcccggatagtccagcttggcccggctgcgcacccgcgcccgttccagagccaccccggtcgtcgccccgtccgcgtccaggtcgatcgtccacaccacggcggcccggtccacgtccgggaagaggctgaccgcgccctcgctgagcaccggcgggtgcagcgggatccgcccgtccggcagatagacggtctgcccgcgcacccagctctccgcctcgatcgccccaccgggccgggcgtacgaggcgacgtccgcgatcgcgtaccgcacccggtagccgcccgactcccggcgctccaggaacatcgcctggtcgagatcctgcgacccggccgggtcgatcgtcacgaacgggacatcggtccggtcggcgagctccggcatctccccggccacccgctccgcctcggcgatcacctcagccgggaactcccccggcagcttcagctcccgccggagaaccgagaagtcgatctgcggcgcccacacccttttgatcggcacgcgccattcctaccagccgcaccctcggccggcccactcaccacaccttcggctcgtccccgacgacgcaaagaagtgagccgcgacccggacccggggcgcggctcactgacctctcaacgttcaccggccaccggccaccactaccgcttgcggccagcggctaccgccagcggctaccgccagcggttatggctaccgccagcggttatggctaccggctgcggcgcaccgcacccgccggcttgcgcaccgcgctggcccgcgacgccgaagccgccttcgcggcgttccggccaccgccggtcgcaccgccgcccgcacttccgttcgtgccggacgtccgagtcgccttggtgcccttggccgcattcccggtagcccgcccagccccggcagccaccgacttgttggccgccttcttggccggcgcattcttggccggcgcattcttggccgatgcgcccttggccgatgcggtcttgaccggtccgttcttggccgagtcgttcctggcggatgcgctcttgaccgatgcgctcttggccggcgcccgcctggccgagctcaccgcggtctccgtccgtgccgaagccgccggcaccgtccgcttggagccggccgctgtcttggccgccgcccgaccggaagccgccttcgttcccgcccggcccgtcgtgctcgtggccgccgtcgtccggctccgaccgctccgggccgccggctcgtcgtcggcaaccgcctgagccgccttggccgccgctgccttgctggtccgtgccgccttggccgccgcggcccggttgctcgcggccaccttgaccgccttcgccgccgccgacttggccgccatcaccgaagcgaccgcctggttggcagactccatcgcctcttcagccttgaccgccgcgaaatccgccgccgcagcctccaccgccgccgcctccgcgacgacagcctccgccgcggccccggcccgagccccgctcaccttccgcccagccaccttgcccgccgcccgaccaccagccgcccgggcaccagccgacttgaccgccgtggccctgcccccggtcgctctggtcgcggtccccttcgtcgccgcagccttagccccagtccccttagccactgtcgccttggtcgctgtcgccttggtcgctgtcgccttggtcgctgtcgccttggccgccgtcgccttggtcgtcgtcgccttggtcgccgtcgccttggtcgctgtcgctttagcggcggtcgccttggcggctgtcgccttggtccccgccgccttggccggagttgccctggtccccgccgccttagttgcagccgccttagcggcggtcgccttcgccgcagtcgccttggtggcggttgccttggtccccgtcttcgttgtggtcgccttcgccgcagtcttcgtcgcgcccgcagccctggccccggtcgccacccctactccagcccggctccccgccgcccccttagtagccgccccgctccgaccggcaccggcagccttcgccacggcaccaccccgcgtgctcttcaccgcagcggcaccagctgccttggccccgccggccttcgccggagtcgccttcgtccccgccgccttcgccgcagtggccttcgtctagctagctagcccgccgcactgcctgaactggcgctgcccactccgccggagcggaccgcgccgctggagcctgccgttccggctgacccgctcatcgcagcccgggccgccgcccgccgggccgccgcttcccgccgggtcatccgcgacggcgccacttccgcgctcgccgtagcctcatccgccgcccccggctccaccgaggtccggctcacgtccccggagtgttccgccgcgaacggtccagccgccacggagcccccgccgtacgccacaccggggtcatccggcaccgcgatcagcctgccgccggcccgcttccccgccggtccgccgggcacggtcccgccgccgaccgccacctgagtggccggcggttcgggctggtccggcccgacccggcccaccgcgagggtccccgcctgcgccgcccgggtggccgccatctcggcctgcgccgcccgaaccgcagccacctccgatccggcaccaccaccgcccggttcgccagcccgctcggcctcctgcggcccggcagtggcaccccgtttccgcaccggcgtactccggatcaccccgccgtcctcgaccgctccttcgtcctcaggcgagaggaacagctgcccccgcgcccgggcactcttggcgaacgcttccatctgcgccgacaccagatccgtggttccggtcccgccggtcccgccggcgaccttgtccggctccgcgagcgcttccaggtcgggccggtccgcaccccactggtcggagtcgcgggcgggctcggtgtcgtcccgcgacggcgcgaaccatccccccaggaacggccgatccgtcaactcactgggcgaaatctccgtttcatccccagcccgtcgccactctttactctcggcgtcctcggtcgagacggtcacctgcgtcttgttcggcacattgctgctcgccgccgcaactcgccgcccacccgacgcgcgccgggccgtagccaccccagcgtctttacccgccttaccgacacccaccttggccgcaccgctcttgaccgcaccgcccttggccgcgccggtccccgccgcaccaaccttggccgcgccggtcttggccgcgctcgccttggcagcgccaaccttgaccgtgttggccttggcagcaccgaccttcaccgggccggcttcagccgcacccgccttggccgggccgaccttgactccacccgtcgaggcagcaccggaccgggcggccggcactttcaccgccgccgacttcgcagctttcgaaggcgtcaccgccttccggcccgcggccgccttcgccaccgcgctgtccgcaacccgcccggtgaccggtttggccactccggaccgccccgcactccgagccgccgcgaccgccttgaccgtcgtcttgccacctgcgaccgggttgaccgcaaccttgctgcccgcgacccccttgaccgccggcttgctcgccacgaccgccttggccgccgagaccggcttggtcaccggcttgtcgccccgtttggtggccgcccgagccgatccacccgccgcccgagccgagccacccgccacccgagccgcgggcaccgcagccgtcccccgcttcgccggcgcagcgcccttcaccgaggatttcggcgtagtcgccgcccgcgccgccggcaccttcttgccggccgtcgcatcccgcccggacaccttcgcccccgccgccttgctcaccggagccgccttggcagcccccgtccggcctaccgccgcacttttcgccccactccgagccgtcggaaccaccgcaaccccacgagcgctcttgcccgccgtcgccttcgcagccggcttagccgcgaccgtcttggcgccggcactcttcgcagccgcagccccggccggagtgcccttccccgcagcgcccttgaccgcagcgctccgaacagaagtagtcgccttggccgcagccccggccttccccgccaccgtcttcacgggcgcagccttggtcacggcaaccttcgtggaagcagccttggcgggcgcaaccttcaccgcagcgaccttcgttgacgccaccttggccggcgaggccttcaccacagcggccttcgtcgaagccgttttcgcagacgcggtcttcgcagacgcggtcttggcggccacggtcttcaccgcacccgccttcaccacgcccgctttcaccccgaccggtttcgccacagcagccttcgccgcccgcgaactcccgggcttggcctcggcccccttaccggacacccgagccgtcacactcgccgagctcttggtcttggccgccaccgcgactccactccccaccttcgccgcggcacgtcccaccgcgccggccttcgccgtacccgccccggtcaccgcacgagccgatcgcccggttccggtggacggccgggcactcgcggccgcggcgcgggttccacccgggcgcggggtgccggcgccggtccgaccggtcgcggcttccggttggcccgcggcggtggtgcgtttggccgtaccgggaatcgtctttgtcgccgcgccggaggtggcgggtctggtcggtgcctttttggcagcgggcatcggggtgttcctccttgcgaatgactgcgggcacgtctgcgccggggaaggggtcggacttggggcgaggtgacggtctagctgttctccccggtccagcgggcgtcttcggcgtcccactcggcattgcgcttctcgaccgtttcgagggcccgcgtcgcttcgtcagccgtggcgaacggaccgagccggaattgggcgggacacacgtcgtcgccggtctcgacccggtggtgtcggaggcaccagaagtagcccgccccgccgagcccactgtcgttcattccatcactctgcaactaaaaacgaccatgcgctaccgattcgggcaaaatgccccaagatttccattgtggagccgagtggattgaccgtcatacctcatcggaacgagccacccggtcaattcgcccggcttcccccgcgcattcacaccacagagacctccacccgcccgcatcgagcccggcagacccctcgatgccgcagaagagacgacacagagccgccccggccgcgcgaacgcgaccggggcggcagaggaggcgagcgggtcagcccagctcggcggcgaccaattcggcgatctgcacggcgttcagcgccgcgcccttgcgcaggttgtcgttggagacgaagaaggcgaggccgttctccgcggtcgggtcgacccggaaacgccccacgtacgacgggtcgcgcccggcggcctgcaacggggtcggcaccgtggacagctcgacgccgggggcggtggcgagcagctcctgcgcccgggccggggacagcgggcgggcgaaccgcgcgttcacctggatggagtggccggtgaagaccggcacccgcacgcacgtaccggagaccagcagctcgggcaggccgaggatcttccggctctcgttgcggagcttctgctcctcgtcggtctcgaagctgccgtcgtcgacgaacgacccggcctgcgggatcacgttgaacgcgatcggccgggggaacaccctggtctcggggaattcgacggcgctgccgtcgtgggtgagttcggtggcccggtcggcgaccttcttcacctgctcgtcgagctcggccacaccggccagcccggagccgccgacggcctggtaggtggtggcgacgaaggagaccagcccggcctcgtcgtgcagcggccggatcaccggcatgacggccatcgtggtgcagttcgggttggcgatgatgcccttgggccggatccgcgccgcgtcggggttgacctcggcgacgacgagcggaacgtccgggtccatccgccaggcggaggagttgtcgacgacgacggcgccggcgtcgacgacgcgcggcccgtactccttggacccgcccttgccggcggagaagagcacgatgtccaggccgcggtagtcggcggtggccgcgtcctcgacggtcacctcaccgccgccccacggcagggtgcggcccgcggaacgggcggaggcgaagagccggagctcggagacagggaaggcgcgttcggccaggatgcggcgcatgacgccaccgacctgtcccgtcgcgccgatgatgccgatcctcatgagcaccaaaatacggcctgaactgcgtaccaagaaatcgtgttgttcatagtgtgggaacgttgtcccacaatagaggacagcggggctagcttcatgggcatggcgacgtacacccacgggcaccacgagtcggtcttgcgttcacaccgctggcgcaccgcagagaattcggcggcatacctgctgccgcatctttcctccggattcaccctgctggacgtcggttgcggccccggcaccatcaccgccgacctggccacccgggtgacccgggtcaccgcgctggagcgcaccgaggacgcgctgaacgcggcccgcgccgagatcacccggcgcggcctgccgaatgtcgacttcgcgctgggcgacgtgcacgccctcgactttcccgacgactcgttcgacgtcgtgcacgcccaccaggtgctgcagcacgtcaccgacccggtcgccgcgctgcgcgagatgcgccgggtgacccgacccggcggcctggtcgccgcccgggacagcgactacgccggtttcacctggttcccgctgctgcccgagctggacgagtggctcgccctctaccagcgggtcgcccgcggcaacggcggcgagccggacgccggccggcggatgctgtcctgggcccgcgcggccgggttcaccgacctcaccgccaccgcgtcggtgtggggtttcgccgacgacgccgaccggcagtggtggggcaccatgtgggcggaccggatcctgaagtcggagatggccaccacggccctggccaccggcgcggccaccgcggacgacctccagcgcctgtcggacgcctggcgccgctgggccgcgtcaccggacggcttcttcaccatcccgcacggcgagatcctctgccgcgcctgaaccgtccgcgagacggcggcccgctagaccatgttgggacggaaggcccagtgccaggactcgcgcgagacattctcgacgaagccgtagcggccgccgttcttgcgcatccaggacaacgcctcggggttgaggtcgaggtcggtcgccatgccccagccgtgctcgctggtgccgggcttggcggcgagcccgccctgtgagtacaggcccttgcgccgggccaggtcgacctgctcggtgtaggggcgataggagtcggtgatcccgatggtgacgccgtcccgcttggcgtcggcgatcagctgggtgagcttctcggcggccggcgcccacagcttgtgccgggtgtcgccgacctgctccaacgcctccggcgggatcctgccgttgccgtaggcggccagatcctccggaatacccttggcattgagtttgtacgtccggcccgcccccgccgcgccctgggcgaccatcgcgccctgcaggtgaccggcgaaggtgctggcgctactgcttccggacgccgtcgtccggttcgtggtgatcgtggccgcctgctgcgtctgcagggccaggatccggctctggatgtccgcgatgcgcgagttcactccctcgattcccacgctctacaggttcggcgtcaccggggaaatctgagttgctccgggaaaatgactcaaccgccgagccctccagccggaccgtgaggtccagatcgacctcggacgtgctgtccctccggttcggcagcacgttggtcaccagcaccagcaggcagccgatgatcgcgtacgcggcgagcacccacaggtgtgccgcgatgggcgcctgggggaagtagaggttctcccggaccgcctgcacgccggccccggtcggcaggttctcccccagccgccggccgaacgacggcaggaactccggcaggatgctggcaccggagatcaccgtcccgatcgtgaagtagaacgcgccgaccgccgcgccggccgggccgatcagcgccaccgccccggccgtcgaaccggtcacggccagcgagatcagcgagaagatgccgagcatctcggcccggttcgcgtcgacgccgaccccgaaccagctcatcgaccagaggaccgcggcggccgaaccgaccgcgtacacgatcagcgtggacaggtgggcgacgccgcgccgccagctgcgccgggtgcgcgggatgagccggccgagccccatcgaggcgatcgtgccgcccagcgacagggcctgggtgaggaagccgagcgagacgccgttcacgtcgtccttcggcagcggcaccacgtcggtcaccggcggcggggtgatcagcgtgcggacggtggcgatcccgacccggtcggtggtcttggcgagcgcggcgacctgctcggcggtccgctgttgcagcaccgcggtgtaggtgccgcgcagcagggtggcggcggccgggccggcggcgcccgcgacatagaggtgcggggtgtcgccggtcagatccgctccgccgtacacctcccgccgcttgatcgcggcggtcagcgcggccgccgacgggaagtcgccgacccggaaccggccgccggcctccagcatcccgatcacctgggcgcgctgctcggcaccggccaccagaccgaccggcaggtggtgcggcgccgcgcggtggcccatgctcaggtagtacgcggtgagcccgagctggatgacgacgccgatcgcacacacgatcagggcgaaccggcggaactggtggactgactggatctcgtcggccatcgaaccagcgtggcacccgggcggcggggaatcaggtcaaatcggaaggatcggtgttggcgccgcagagcagggtggtgacccgctcgccgggggcggggcggtacgcgccggaggtgagcgccgcgtaggcggcggcggtgccgtgctcgacgacgatccggtagtcgtcccagagtgcgcggcgggcgcgcacgatggcgtcgtcgtcgaccaggatcgcgtcgattttcgcggtggtggccaggtcgaaggcgatgtcgccgacccggcgggcgccgagggcgtcggccgcgacgccggataccgggacgtcgacgggatgccccttctccagcgcggcgtggagtgcgcacgaggtcgccggctccaccgccacgatccgcatgttgccgacgtttccggcgatcaggccggcgatcaggccgccacccccgaccgccacgagcaccgtgtccgagacttcggatatttcgtgggctatcgtgccgtttccggcgatgagcgccgggtcgtcgtaggcgtggcagaacagtgcgccggtccgctcccgcgccgccgcgtacgcctcggcgtactcgttgcccacctgcaccaccttggcgcccagtttgccgagcttggcgaccttcaccgcgggggcggtcaccggcacgaacacctcggccggcaccccgagctcgcgggccgcgtacgccgccgccaggccggcgttgccaccggacgccgccacgatcccggccggcggaacgtcgctgccgagaatcttgttcagcatcccgcgggtcttgaacgatccggcgtgctgcaggtactccagcttgaaccagcggtccggcccggcctggagcagcggggtgcgccggatccggccgtcgatccgccggtcggcggcctccacatccgcgagcgtgatcatgtgatcaatctaggcctgcccctagacgacgctccagctcacctgactggacgggacgggtaggcgctcgccgatcagccgggtcagatccagtaatcggtgggagaagccccactcgttgtcgaaccagccgcggacgctcaccccgccgccggccgtggtctgcgtgccggacgggtcgaacaggcaggacgccggattgttcttcacgtcgatcgacacggtcgggtccgggtcgtacgccaggatgccgcgcagtggaccggccgccgcctccgccatggcccggttcacctcctcgacgctcaccggccggtcggtctccccggcgagttcggcgagcgagccgatcggggtgggcacgcagtagtagctgtagcgcatctcgccgatctccggcagcgccacccggaccaggtcgccgaccacgtggttgtgcggaatgatgctctccccggtggcccggcccagccgcggatcgtcccgcgaggcgccgatcagcgagtcctgcacccgaccccagccctgggtggccagcatcaccgaggtcttcaccgcgtgcaggccgaaccggtcgagcagcaccttggccatcacggtcagcgcgttcaccccgcacgaggccggcgagaccacgtcgtgcacgcccgggttgtagctcaggtggttcgccccgaagatcaggaacgcgtccgggtcgtcggccgaggcgctgatcaccaccttgcgggcgcccccgtgggtgatgtgggtgcgcgcgctgccgccggcccggaaccgcccggtcgcctcgatcaccacgtccaccccctggtcggcccagggaatccggtccggacgttcctggtggtacgtccggatcgcgtgatcgttgacgaccaggtggtcgccgcgggcggtgaccgtgcccgggaacgagccgcgcaggctgtcgcgccgcaacccgtacgccagcttctcggtgggcgcgatgtcgttcaccgcggcgatcgagatccccggattcggcgaggccgccacgatacgagtcaaactgcgaccgatccgtccgagcccgttgatcccgatcgcgacagtcatcgagcgctccccgactccgttgctgttgtgtgttccccgcccatcgaggacacccccgtttcgcaccagggtccacccggcgttacgacttcgacactatgagttgtgcaagttgcacgtcaacggatgacaatgtcacaccagccgagtgacgcccatcgaagccccatgctcaatgtggaatgcgttgcggcatgctgggcacgtgcccgtactcctgtcctacgcccccgcggacgcacactgggcacaatggatcaccggatcgctgcaggccgccggccatgccgtgaccatgcatccggccggggtcgacttcgcgcatcggatgaccgtcgcgctatccggatcagatcgggtgctcatcctggtctccgcggagcatcccgcgtccgaatcggactgggcgcgggtcgccaccacagcgggatggacggtgctcgccctggacgcggttcccctgcccgcggcactcgatgccgcgaactgcaaaagcttgcatgacctggatgaagaagaggcgctggagatccttctgggggcggtgggcggaccacgggactctttttcgcgtacgccgcaatctcgccctgtttgatcgtcggagagaaggggtagtgaccgcttcccgtccgtttctttccgtctcggccttttccgtctcggtcagcggaacgcccgatacagcagaatcaagccgatcgtcgtgccgaacgtgacgatcaggtatttgagcaccgtcgccggaagccgtcgggccagccgcgccccggcatacccgccgaccaccgtcgccggcgccagcgtcgccaccgccgcccagtgcacgtccgcgaagaacgcgaacaccagcacggtgaccagccccaccgtcgccgacagcacgttcttcaacgcgttgatccgcttcaacggctcgtccagcaccagcgcgagcgccgccacgtacatgaccccgagcgccgccccgaagtacccgccgtacaccgcccccacgaacacgacggcctgcaagatcaccgccgcccgccgtgccggcatgccgcgcggatgcccgaccagcccgcgcagccgctcctggaaagccagcgtcgccgccgcccccagcaccaggaacgggacgatcacctcgaacacccgcccgggcgtcgacagcagcagcgcacacccgcccaccgacccgagtaccgcggccggcagcaccgaccgcacccgccgctcctggccggccaggtccgcccggctcccggccacgctcgacacgtaccccggaaagaccgacaccgaattggtgacgttcgcgtccacggacggcaacccggccgcgatcaggctcggaaaggtgatcagcgacccgcccccggcgatcgcgttcaccccaccggccgcgaccccggccaccaccagcagcaagatgtgcgaaagatccatgatgcggccgaccctacgccctgcccccaccggccgggccgtaggattggggcgcgacggacgagtcggctgggcggccgcgtcggtgcctccgggcatcgccgaggaacgtccggactccgcagagcagggtggttgttaacggcaacccggggcgacccgcgggacagtgccacagagaacagaccgccgccggggcctcggccctgggcggtaagggtgaaacggtgaggtaagagctcaccagcgccccgggtgaccggggcggcttggtaaaccccacccggagcaaggccaagcaaggccgcgcccgcaaggacgcgaccggcgcagggttcgagggctgctcgcctgatcctgcgggtaggccgcaagagcctgccggcaacggcaggccgagatggatggccgccaccgggacctcggtcccggccacagaatccggcgtacaggccgactcgtccgccgccccccgaggtcaccactctgcgggcggcgcccgcccggcctcatatatacggtcaacgtcggccgccgtctcaagctcccgactccccacctgcagaggggtcatccctgtcgcccgggctccgcataccggcgaggacggttttgctcacgtcgagcccgggcccgacgatcgagacgcgggactgaggtgcgccgcactcgaaaaggtcgggtggtcacggcatgcctctgcatcaggatcgaccgggagatgacgtgagcgacgacccgtcgggacgctctgcggtcgcggtagaccacctgacgagtaagcctgtccggacgttcaagatcaagcgtcccatggccgggttcgtcccggtgatgatcgcggtggtggcggccggtcccctgcacgcccatgcgggagcaaggcccgaggccaacgctcctgcgatcgcaccgatcccgggcgaccccgggtggcagggcgtcgtcgtggccgacgtgcactgtggtgacgctgatccgtgccggcgagtccccaccgatccagcgctcgccgacaagtccgcgttctggggtccggacaatgacacccggcagttgatcagccaggtggaggctgccctcgcgaaggatctcgacaagcgcacggcctgcggcctcgacgacaaggcctgtgccgccaagccgccgtcaccggcaggagtccggcaggcgctcaccgccgccggcatctcgcatttcgaggtgcggacggggggactggaagcaggcgtccccgagggcaccgtcctcgtgggtatcccgcacggacctggctgcgtgatcgtcacggtgaccggctacacgcacgacatctacaagaacttcgcccagcctgacgggacctgtctgcacgcgtgaaggcgacgtcggcaacaccgcgaccatgacggccctcgccacctgtcccgggcacgcggacccgcgattcgcctctatccttacgccatggacgacatggtcggctgggtcgcggttgtctcgttccgcgccggcaggaatccgagcccctggcaggtttgactgcgcggctggggcatcgactgggagccgttcgagcaggtccgcggcagcctcgcccgcaccgagtatccggacgggacgatcggctgccagcagacctaccatgtccggcaggccgagctggatcgtctcgggatcagcgtcgggcccggacctgctgcgtcacctcgggatacgacccctgctggtagggctgcgccgcgaagaagcccgccagctccgcctgttccaggacgtccttcgcggcgcgttcgcgagcccgttcggcggccttggccgcccgtgaccgggcgacgtcctcggcggccttcgccgcctgattcgcccgacgggtgacggccgctttggcggcccgccgccgggcgacttcggggtcgaggcggcgggccgggcgcacgtccgcggtcgcttccacctcgcgggcctcgatggccgcgaagtcggggcggattttggcggcgacccattcgacgccggcgaccaggccgaccaccagggagaagatgatgcgcaggccgagtgggccgggtgccgcgaagttgaccgcggcggagatggtgacgaccagaacgaggaccttgagggcggcgcgtttggcgtcggcggccatcccggcggtctggctgatcgtcagcatggacagcatggcgaggtcgaagacggccggcacgatccaggcgaacagtccggcgtcgaggctgaccaggtagtggccctggtgcaggtagctggcggcgagcgcgccggcgaggatcccgttgttggcgcgtttgatggtccggatcgcgcgcagcatgcccggcaccgcgcctttggcgtattcggtggcgaactgctgcgtcagcgtcatctgcgccggcaacgcgaccccctgcagacacgaggaaccctcggagaacaggcccgacgctaccggagagtcggtcgaacaggggcaaggttcgcaacggaccgcaaggtccgcaatcagtcgacgagcgcgccgcgccccgaccgggacgcggcgcacgaaactgatcggaaccggtcaggtggaggagaccgtctcgaccggggtcggctcctgcccgacccgcggatcgccctcgtcggcgaagtagtcgccgggtgccgtgccgtccaccccttccggggtcttcgcggcccgcagcgcgaatgtcaccaggaccgccaccgccaggttgaccagcaccgccacgaacccgacgtagatcgtcttcttggtgtcgaggccgaactcggagagcgcgaacgccgacccgccgaagtgcttgcggccggtcgccgcgttcgggatctgccacagcatccagaaggcgagcagcatgccggcggcccagccggcgatcagcgcgccgcggtgcagccaccgggtgtagaggccgaggatcaccgacggcgccgtctgcagaatgatcacgccgccgatcagctgcaggtcgatggagaactgcgggtcgaggaagacgatgaacgccaccgccccgatcttgacgaccagcgaggtgatcttggcaacgttcgcctcctgcgccggggtcgcgtcccgcttcaggtactccttgtagatgttgcgggtgaacaggttcgccgcggcgatcgacatgatcgcggccgggaccagcgcgccgatcccgatcgcggcgaacgccaccccggcgaaccaggacgggaatttggtgtcgaacagcagcggcaccacggtgttgctgtccaggctgccggccttcgccccgggcagcggcttcaccccggcggcgatcgccatgtagccgagcagcgcgatcaggccgagcaggaagctgtacgccggcaacgccgacatgttccgcttgatcacgtcacggttcctgctggccagcacgccggtgatgctgtgcgggtagaggaacagcgcgagcgccgaacccagcgccagcgtgaagtactgcacctggttgttggcgttcagcaggatcccgtcgccgggcgccggcgtcgcctggaacttcctgtccgcggcatcgaagatcgcaccccagccaccgagtttgtacggcaggtagagcaccgccacgatgatcacgaggtagatgagggtgtccttgacgaacgcgatcagcgccggcgcgcgcagcccggactggtaggtgtacgccgccaggatcgcgaacgcgatgatgatcggcagatgccgggccaccgcactgtccccggtcacgcccatcgtcttgagcaccgactcgatgccgaccagctgcagggcgatgtacggcatggtcgcgacgatcccggtgatcgcgatcagcagcgccagcgtcggcgagtcgtagcgccgccggacgaagtcggccggcgtcacgaacccgtgccggtgcgccaccgaccagagccgcaccaggaccaggaagaacaggggatagatgacgacggtgtacggcacggcgaagaacccggccgcgccggccccgaagatcagcgcgggcaccgccacgaacgtgtacgcggtgtagaggtcgccacccaccaggaaccaggtgatccacccgccgaagctgcgcccgcccagcccccactcgtcgagatgagccatgtcctgcggcgcccgccatcgggccgccacaaaaccgatcccgctcaccagcaggaacagcaccgtgaagatgacgatctcggtgacgtgcccgctcatggccggctccgcttccgggtcatccggtagaccagcgtggtcgtcgccacgcccagcaggatgaaggcgaactgcagccagtagaacagcgggaacccggcgaaccggggcgagtcgtgattgaacaacggggtcagcagcggcaccacgatcggcaccagaagcaaccagttccagacactgctatcggtacgtggtgaagatttcagctccgccatgatccgccccctccagtagcgagacagtgcgtacagtccccgtcacgctaacgagacacccggatcactggcgatcggagtgcgccgaacgggcgaagggctgcgccgaacggcgccggggcgggtggagcccggcccctggtgggaccgggctccggtggtgccggtggatctcccgggtcagaacaggcccagggagatcgtcttggtgagggtggcgttgtcgtcgtcgccgtcgagggaccacatcatcgcgccggccaggccgcggctgcggatgtacagcgtcttctgcagcaggacggccgggtcgtcgtacgtccaataggtggtgccgtcgaacagccaggcgtcgccggagcgcaggtcgcggtgcacggtgtaacccttggccggcagggtcttgacgaccttgtagtcctcggtgccggcgccgaaggtgccggccgccgggccggtggccggctggaaccgcccggtgccgccgccggtgacgccggtccagccctggctgtagtagggcaggccgagcgcgatccggttcttcggggcgccaccggcgacccaggcgtggagcgcgttgtcgaccgagaagtccggattgtccggcgcgccggccggaacccgcagcgccgactgctggttcgtcctcgattcccaggtgccgtggaagtcgtagccctgcagggtgccgaagtccagatacctgaagatcttgtcggcctcgaagccggcaccgatcttcgccggggcggccggcaggaacgcggtcagatcgtagtgcttgtggttggtccggccgagccggtcgagctgggcgcggaattcggcggcgagcagcgtgaagttccgcttgtcctcgggccggaccacgttgccggtgttgccgtccgagccgggccactcccagtccaggtcgacgccgtcgaagatgccggcggcggcacccgcggcgtggtcgggcaggttgcccttgagccacagatccacgcaggacgagacgagcttcctccgggaagcgtcggtcagggcggcgtcggagaagtacgccgatccgctccagccgccgagcgagatcagcacgcgcagccgggggttggccttcttcaattcggcgagctggttgagattgccggcgatcggctggccggccacgtccccgacaccgtccacactggtggcgtcggagaacggcgtctgccagtcggcccacgggtcggcggaggcgcagacgccgtccgcggtgaccgggccgaacgcgtagttgaggtgggtgagccgggccgcggcgcccgacttctgcaccttggccagctgaaagtcgcggccgtagatgccccactgggtgaagtagccgactttgacgaagcccttgctcgcctgcgcctcggcgggcgtctgcgccgcgcccagcacgaccgtggcggcagccgccgcggcgacgaagcggcggatgaaaccgttcatgagccctccagggcgaaacggtgaagaaagtttcctgatcgaggaaactaaacgtctcgccctggcagggtcaatatctgttatcgaagatgggcagtctcgttgaccgaccggaccgcgatgttgccgtccggccagatgtccatggtcgacactccggcagcatccaggaacaagcggtgcaggaaggcatccccggcggcgagcgcgtcgcgcaggatcaacttgatcggcgtcacgtgcgaaacgaccacgaccacctgaccctcgtacgcctgctggatcttcgcgagcgcgccacggacccgcttcgccaccgcctggaacgactcgcccccgggcggtgccacgctggtcgacgacagccaggcggtcatctcgtccggccagccctcctgcacctcggcgaaggtcttgccctcccacagcccgaagtcgcactcgatcaggtcgtccagcacggtcaccggcaccccgcccacctcggcggcgatcagctcggcggtccgcccgcaccgggccagcggcgaggtcagcaccaccgcgacgtcccgggacagcccggcgacccggccggccgcggccatcgcctgcgcctcaccctcgtcggtcagcggcacgtcgccccggcccgagtaccggccctgcgcggtcatcgcggtggcgccgtgccggaccaggatcagccgggtggcgttgtccagctccggcggggcccagctgcgcggctggggcgcggcggcgggcacatccgggacagccttaccggcggcctcgtccatcgcccggttcgccagcgcgtccgcctcccggttgcgctcccgcggaatccagtcgaagctcaccgtctggaacctggcgaccagctgggccgcctccgcggccagcgggcgcagccccgggttcttgatctgccagcggccggacatctgctcgatgaccagcttggaatccatccggatgtcgacccgggcggcgttcagctcggcggcggcgcgcaggccggcgatcagtccggaatactcggcgacgttgttcgtggcggtgcccagggcggcgtaccgctcaagaagaacctcgccggtggccgcatccttgaccaccgcgccgtagcccgccgggccggggttgccccgcgagccgccgtcggcctcgacgacgacccgcaggccggcgctcacagacccgactccgcggtgcgcaccatgatccggcggcactcctcgcagcgcaccacctcgtcggccggggcggacttcacccggttgaggtcggcaccgtacagctcgatccggcacgccccgcagcgcccggcgtacaccagcgcggcacccatcccggtctcggtgcggatcttgtcgtacagggtgaccaggtcggccggaagatcaccggcgagcggcccccgggacgcggccttgaactcctgctccttggcgatgtcggcgtacgcctcgtcgcgccggcgttccgcgtcggagcgccgctgcccggcagcggcgatccggccctgcacgtcggcgagcgccgcggtggccgcctcgcgctgctccatgagctccagctcggcgtcctccagctcggactgccgccggttcagcgtggccagctcgtgctgcaggccctcgacctgcttcagcgagccgcccgcgtccagctgctgctgatccttcgccttgcgctggcgcacctggtcgatgtccttctcgaaccgggcgatgtcccggtccaggtcgtcgaccgcgacctgggcgcggacccgctcgtcctccagcgcggagatctcccgggccaccgcctcgatctcggcgatctcgggcaggttcttccggcggtgcgcgagctgggccagggcggtgtcgacggcctgcaggtcgagcaggcgacgctgggcttccggggcggccttcacgagtgaatctccttgtgcgcagaggcggaatgaacggtccaggggtcggtgtccaggtcggacaccaccacttcgacgggaaactgcgcgcgcagccaggccgccacgtcgtccagccacggtcgctcggtcgcccagtgggcggtgtcgagcagggccgggccgtcgttcgcgagatgctcgccggccggatggtgccgcaggtccgcgcaaagatacgcgtcgacgccggcacgtgccgcgtcggccaggaaggagtcgcccgcgccaccgcagacggccatcgtccggatcacccgctcggggtcgccggcggcgcgcaccccggccgcggtggccggcagccgctccgccgccagcgcggtcagccgggccagggtgagcggctcggccagctcaccgatccggcccgcgcctagctagctagaggccgagccgggcggccagcgcgtcggacacgccggggttggccacgtcggcgttggtgtgcgcggtgtagagggccacctcggcacggatcagccggtgtgcgatccgccccttgaaggtgtccggggcgagcgacgacaccggcttgagcagcagcggatggtgggcgacgatcagatcggcgccgacggcgagggcctggtcgacggtttccggcacgcagtcgacgacgcacaggatgcgggtgacggcgtgctcgtactcgccgagcaccgggccgacccggtcccaggactccgcccagctccgcgggtaacgcccgtcgagggcgtcgaccacctggcgaacggtcggtacagcggcagggtccacgaccggaaactctatacgtctaggaaaccgccccaggctcgactcggctggccgcggtgatcggaccgctgaccgcctgcagggcacgccgccacgggaactggccgcggaaccggtcggtctgccccggaccgccgagccggcacacgtcctccccgtagaggacgtgcaccccccagtcgcgcagcttggcgaggctctcgtgcagcgcggggtgcagggccatgaccttgttggtgtacggcacgacggcggtcggcacgccgtacccgtagccctccaccaggagaccgagcaccagcgtgtcggtgatcccggcggcccacttgttgaccgtgttgacggtggccggggcgacgatcatcgcgtcggccggcggcagcacgtccgggtcgccgggactcttgtagaaggtgcgtaccggatgtccggtctgcgcctgcagggccggaacgtcgacgaacttccggccgtccggggtggtgatcacgcagacctcccagccgtcccgctgcgcgagcccgaccaggattcccacgtcccgggccatcggtgagccgcagacgaggacgtacagcacaccgggtgaggggttacccgtcatcacgcgcggacccacctcatacgccgactcccatctgttcggccagctccgcgatcggagccggcggcgtgccccgggtacgccggagcacgtcggaaaggatttcgtgggcgagcgggcggcagcggatctccgagggggcgagacggtcgccctccagcagcatctcgccggccttgtccacgtcgccgatctgtgtgtagccccgggcgatgtccaggtagtggtgcgcccgccgctccggcagcagcgcgttgaacccggccatgtccagtgccttctcgtgggtctcgaccgcctgccggccgtcgccgagctccaccgcggtggcgcaccggtgcaacagcacgttggtcgggccgaacgacgtccagtagtggttgaagtcgccacccagctgccgggacgcctgatcggcgccgtccagcaggtcgcgcacggtggcgctgtccccgatccgggaggccgccatcgccccgttgagcagcagcatcccgtacaccgagagctggtcgccgtcggcgcgttccagcccgcaggcgagccggttggcgatgttgacgttgacctccagcgatgggcggacccggccgagtgccagcagcgcgctgcccacgcggtaactggccaggccggccagcagctggtcgccggcccgctgggagaccgcgatcgaccggtccgcggccagccaggagagctcgtgctcgcccactttccgcagcgccgacgaggcgatctggtagacctgcccgagcaggtgcgccgccttgggcgcctggtcgctgttggcgtgcgcggtgtccgccgcctgcgcgtcgcgcaacagcttgggcagtgcgcgcgccagggcgccgtacttcgcgtgctgataggtcagccaggcgtggctgaccgctttgtgcatctccgcgaggggcggagattgcggcacggcctggaagaacgcgctcatctggtcatagcgctccagagcggcacgaatctcctcgacctcgacctgatcgatacaggcctgggtctccggcttgcgctccacctccttgcccagcagcagctggacatcgacctggagcacgtccgcgatgtcatacaccacggagaacttgtcgagtcggcggaccccgcgctccaccttgtcgacccaactcttgctcttgcccaaccggtctgcgaagacctgctgagacatcttccgcctgccccgccagtaggcgacgcggcggccgatcggcagctcgtccacggtgcctcccccactcacccggcggactctccgccggtgagccatccggtgacctgcagtctgaaccgctcacgtgcgcacagatcgcacagcgtgtgtgatcgcctgctcaccgatgctcgtagtttttcttgcaagttgcaaagggtggatctgaccggcccaacgagactcacctcgatgggatacggcccgaacactcgaatccgggggagttgggctatgcagtggagcagccgtcagccgttcgtcccaccgtcttttctcgatcgcctggaccgggtccggctgcgccgggccgcccagaccttcgccggccacggctgggcggtcgcacccggcgccgtcctcaccggaccgcggttcgactgcgggcggcccggctgcccgatcaccggatgccatccggccgtcgactcgctcgccgaggcggccaccaccgaccccggccgggtcgccgcatggtggcggcgccggccgcacaacgtgttgctcaccaccggggagagattcgacgtgctggaggtcccggcgctgctggggcggccggtcgcggaccgggccgccgggccggtcgcggtcaccgcgggcggacgctggatgttcctggtccggcccggttgcccgctgcgggcggaactcgacctgcgccaggacgtcgtccgccacgggcacggctcgtggatccccgccccgcccagccggatggtggaggggccggtgcgctgggtgatcccgcccagccaggtggattgggcgccgggcgatccgggacggatccaggagatgctcgccgcgagcgcggcacgaaccgggtgggctcatcgcgtaccgcggcaattgtcgaccttgcgccgcgcggcctagagcgtcgcgagcccggccgtgcggcgacgtccggccgtcggccggatgccgggcatttgcgcgcgaacacatgtcgtccgacaaggtatcccggcccgcgacccggtgggagtcatccgaccgggtgacgcggatgaatgaaaaatcagaccccgagttcccggtacgcggtgatcaccgctgccgtgcgatccgcgagctccgggccactctcggcgaccgggacgccaccgacccgggcaagcgtccgctcggcgtgccgggcggtggccgccacctgctgctcccggatgaagctctcgccggtgcgggccgcggcgtcgatcgcccggatgatccggttcgccgccgcgccggtctcccgccacagctcgtccgcgcgctcccgctgcaggtcggcagcgatccgggccgggctgtcggccgggatgtcggcgtcctcggtggcggccagaccggcccggacccgacgcagctcctgccgtcgggccagcagggtggccagctcgtccagcgcccgggtcagcgaccggtcggccagccgggtgtcgatcatcgcgcccagggcgggccaggtgcggcgaacccggtgcgcgacggcgacggcacgggtgaaagccgcccgctcgggctcggtccagagcacccgcccctcgccctcgcccggccggcggaaggcgaccggctgcgcggcgcgggcctgccggcgccagagccagaccaccagagcggtacccccggccgccggcaaccaccaggtcaggccggccgcggcgagcaccgcggcgacgaagagcaggggcagggcgaggcgggcggtgttcgtcacgcgaacctcgcggctgcgcccggaaggcgggcacggcacggcttcgaccatcgatccggtacgccgtgagcgggcccgtccggtccgggtgcgcaccgggcgccccgcgaccacgaccttctccgcgtcggcgccgatgtagagctccgtgttcaccgcgcctcccccgtcgtgccggcatccgggcgggcccgaaccgccgaggggaaaccggccggacccgcccgccgcggtcatcccgcggacaccactacggatcggagacggcaccgaagacttgagccgccacccggttgcgcgggcgttgcgttagcgttcccgggtggactcggtcgacctggtgttacgcaaatacgacggacggccgcaccgccgggtcaccggccgcctcctcggcgaggacgagcacggcacctggatcggcaccccgcgcggcacccgggtgagctacagctacggcctacgccggctctcctggacccgctccgactcggtccggctgatcccccgcgacacctggtggatggcgatgttctcggccgcacccagccgctccgagatctactgcgacgtgatcaccccggcccggcgcacccgcccgcacgaattcaccgtgatcgacctggacatcgacgtgatccggctgcgcccggacggccgggtggtgatcgacgacgaggacgagttcgccgcccaccggatccgcttcggctacccggcgcaggtcgtggccgaggccacggcggcggcggcgaccctgcaggcggcgctcagcggcggggccgagccgttcgcgacgcactaccgggagtggctcacccgggccgcggccctgccccggccactccgctgaccgctcgcccccgacattttctgcttcaccctgcccgccggccacggacccgccgcccgttgcccaccggccacggacccgccgcccgttacccaccggccacggacccgccgcccgttgcccgccggccgccgggcacggtttcccgcccacccctgtccggcggccgccgtcccagcccctcagccgcccggcgcactcccgaaaaattgtcagagggtcgccctaggttcagtccatgaccgacacagcactccgggactccccgatcaccctcgaccgccgcctcctgctcggcgccacggattacgaggtgaccgtcttccccaccgacgaccagcgcctggagctctgcatagtgagcagcgacggcgacggccgggtcctgagcgagctcagcggcagcctcaccccggccgacctgcccaccctcaccgaggtcctcacctccaccctgtccggcctccgcgcgatgaccaccccaccaccggccaccccaccacccaccccacccgagcctcccgcccagcgcagccggcccgccaaccacggcgcccgctggaccaccgccgacgacgaccgcctccgcgcccgctaccgcgagggccccacccagtccgccctcgccagagagttcggccgcaccccgggcggcatccgctcccgcctcgaacacctgggcgagctcccacccggcgccccctggcgcccaccccgacccaccgcacccaccgatccactcgccaccaccgggatcagcaagcccacgccgccacaggcccagccacccccggccccccactccggcgagcccgaccctcgcctccccaccaggcctcccacagccgggtgaccaccaccggcggcgggccgctcccccagcggcccgccaccactcacccggtccaccctgcccgcactccaccccactcgccccggccactcgcggcgagccacccgcccgcactccaccgcactcgccctggccactcgcggcaagccacccgcccgcactcgctccggccactcgcggcgagccacccggagcctgcaccgtctgccgtcgcacaacacctgcgtccaccggacaggaggcgcgcatcccggccactccagcgcagtccaacggacgacacccgcgacccgctgcggcgaaagtccagcggccgtcagcttgaacctcgcgatgaccactcacaaccaaccggctcgcaggcctccatcggcctcagccaacaacgcccattgcgaacagtccgctccggccaacgacccacacaaccaacggcctacgcacgccactgcgccaccagagggccgccgcggtgaacggtcgtcgtattcggagccggcgcgccgcacgaggcgagggcgatgaaacccagcccgcagcgcgccagtggaagccggcgcggaacgtgcggcacaaggcgcagggcgcggaacgcggcgcagggcgcacgcgcgccgccaagcgcacgcgcggcgcgggagacgcggcgcagggcgcggggcgcggatgtaggaggcaggcaggaagcttgcctagctagctagaggcacggccgacgcgcaggcacggccgacgcgcaggcacggcccgacgcgcaggggaacgcgcggcgcagggcgacgaaagaaagcgcacagcgcggcaatgggaggcggcgcacagcgcgaggcgtggacgacggaagacaacgcgaggcgagggcttcgaaaaccgacgcgcagcgcgggacgagaacactgaaagccagcgcgcagcgcgaggcgacagcactgaaagccagcgcgcagcgcgaggcgagcgccccagaggcgaccgggagcgaacggaatgcggggtttccgggggctcggcccccggagtcagcatgacgaccgccttggtccgcgcactccgcggacagggggtggccaaggtcgtgggcgcggtaggtttcgaacctacgaccccccgcttgtaaggcgggtgctctcccactgagctacgcgcccggtgttcaccggagtggccatcctaccctgcgcggggatcaggtaccgagggtggcgagggcggttcgccaggcgtgctggtcgcgggtttcgccgggggtggtcatttcggcgaagcggatggttccggtggggtcgatcaggaaggtgcctcggttggcgacgccggtctcctcgttgaggacgccgtatcggcgggcgacttcgccgtggggccagaagtcggcgagcagggggaagtcgaagccttcccggtcggcccagactttgtggctgtagacggagtcgacgctgacggtgaggacctggacccgctcattgacgtagtcgtcgaggtgggcctgaatttcggtcagttcgccgtggcagcgacgggtgaaggccaaggggtagaagaccagcaggactgctttgcggccgcggaaggcggagaggcgtacctcttggttgttctggtctttgagcaggaaatccggcgccggcgcgcccacctcgatcggcacggccccagcctagccgtcggtcccggcgccgcgccgatggcggcatggcgcggcggcggcatcgcggtcgccgggagccggcgccgtaaggcaggtgcgttgcggtcgccgcgagccggcagccttgcggtcgccgcgagccggcagccttacggtcgccgcgagtcgcgacgtaaaacagcagcattgaggtcgccgggagccggcgacgtaaaacagcagcattgaggtcaccgggagccggcgacgtgcggtgggcatgccgatcggccggcgcccggagggcgccgaccaggccaggcggggtgggcggtgagctacttcttcttggcgccccgcggggagaccagccgggcgccggtccagtccttgccggcgttcagcgtcgaggtctgctgcaggccggcggtgggggccgactcgctgatctcgctgggctcgacgtggccgtcgcggccggctttcggggtcagcagccacaccacgccgttgtcggcgagggggccgagtgcgtcggtgagcagctcgaacaggtcaccgtcgccgtcgcgataccacaacagcaccgcgtcgacgacctcgtcggtgtcctcgtcgaccaaatcaccgacgcgttcggtcagggcgtcacggagctcctcgtcgacgtcgtcgtcgtagcccatctccatgaccaccatgttcggctcgaagccgaaccggtccgccaggctgcgtacgccgtcggcctgacccgcggtcgcgctcactgtccaaatcctcctagccgtggaaactcatcaaatagcaccggaacctgggggtagtccacacactccggcgctccggcgcaagtggcgcaccgagtgtgtggcaatttaccgcgccagcagggcgtgggcaccctgtgtgatggcatcctctcccaccagcacgtgctgggcggctggtccgagtggaaccggggcgtcagccgcggccacccggcgggcggatccgacgaaggagccgtcgaccagggcggcgagcactccttcgccgacgccgccggagcggcgggtctcgtcgacgatcagcacccggccggtggccagcgactcgcgcaccaggtcagcgacgggtagcgggctcagccagcgtagatcgacgactcgggtgccgtacccgtcggcggccagccgggccgccactcgcagggacatccgcaccccgccaccgtacgtgacgatggtcaggtcctgcgccgtgcccagggtgtagatgcgggcgcggccgatcggggcgtgctcggcggcccactgggccggccccggatagggcgacagccactcgttgtcgccttgctgatagaggtccctcgtctgatacagcgcggcgggttcgaggaagacgcagacgctgccgtccaggtcggcggcggccaggcaggtgcgcagcatcggggcggcgtcctgggcccgggccgggacggcgacgaccaggccgggcacgtcgcggagcacggccagggagttgtcgttgtccagcgggccgcccaggccgtacgggtcggcgagggccgggacgcgcagcaccagcgggttgcggtaggcgccggaggacaggaacgacatggtggccgcctcgacccgcacctggtcctcgccgctgtgcaggctgcccaggccgggcagttcgggcaccgggagcaggccggccaggccggcgccgagggcgagaccgaccacgctggtggtgtccggcggggtgtcgaagacccggtcgccgccgcggtcgcggagtccggcggtgactccgtgccggccgccgcgggtggtgccggggccgaacacgagcaggccgggccgggcggcgagggcgtcggtgagggtcgcgttgatcgcctgggcgagggtcatcgggccggcctgttcgggcagccggccgccgaagacgcgggaccggttcgcgccggccgggccgagggcgcgttcggcggcgtcggcgatggcgtgcgcgacccgcagtgggcggcgtggagcgagcgaggcgacgatctcgccgacggtggcgagtttcggttcgccgagcacctcctcggcggctttgcggacctgccagccgatctcgtcgtaccgggtgatcacctcgtcgacggtgagcagaccggtttcgacgagcagccgggcggtcccggcgagcgggtcgcggtccaggtcggggccggggtccgggtcccccgggcggcccagcagtcggaccgtgcccaggtgcagcacggcggggcggcgttcgcggcgcacgtaggcggccgcctcggcggcggcgtcgtgggtggcggccaggtcgccgccgtcggcgtacgagtagctagctagctagccccgtcgtcgccgaaggtggcggccacgatcgcgtcggccggccagcgcgggtccggcgagcggctcaacccgtacgccagtccgaccgcgcgcggcaggtgacccgccggcgtcgagaccaccgggaccaggtgcagcccggcgttgccgaagaccttgtcgcggccgccgctgatcgggtcgcgcaccgaggcgacgacgccgcgcaggatgtcgcgggcggcgtcctccagccggtgggtccggtcgccgggggccgacgcggcggcccgcatgcagtagaacgccgcggcccggtcgtgcggcagggccggatcgtcgccgcgcagcgcggcggcgaccgccgcgttcccctcgtggccggacgacgcgacggtgtggaagccctcgttgaagctgcgcagccagcgcgcggccaggtcgaggtgacggctggtgagctgggcgtcgaagatttccagggcgcgggcgccggtcagcgtggagccgtcgcggaccgggtcgccgggggcgtgggggtgctccgggggccgcagggccgagaccgcatcgcggaaccgctcgtcgaggctttgcggggtggtcacgaaatcagcatcgcggaccggggcgagcgctgccacccgccggaacccgatcatctgagtcgatcttcctgcgcgacggcccgccccggtggtgcaatcctcggatgatcatgtgccggctggtcctgtgggcggcctggctgaccgtgacggcggccctgttcctggcgctggacctgtacacataggcttcccggatgcgtagcgaagtgatcaccgtccggaccgggaacgccccggtggtcgtcgacatcaccgcccgggccgaggatttcgtccggccgcagggggacgggctgctgcacgtcttcgtgccgcacgcgacggccggcctggcgatcatcgagaccggcgcgggttccgacgacgacctgctgaccgcgatcgacgagctgctgccggccgaggacaggtggcggcaccggcacggctcccgcgggcacggccgtgaccatgtgctgccggcctggatcccgccgtacgccacgctgccggtggtcggcgggcggatcatgctcggcacctggcagtcgatctgcctggtggatccgaacggcgacaacccggagcgtcaggtgcgcttttccttcctggccgggtgaccccggaaagttactggtcagtacatgtgtcgcgcatcgctgcgccgaccgttaggcgtgacgatgcccaccgttaagaggcaggatggagacctccgggcgatacgccaccttgatcgcaccggttccgacactcaaccaagaggattgcctgtggccacggagcgcaagcgcccggtgatcagcgatggcctgccgagccagcttccggacatcgacccttcggaaacgaacgaatggatcgagtccctcgacggagtcatcgacgagcggggcgccaaacgagcccggtacgtgatgttgcgcctgctggagcgcgctcgtgaacgacaggtgggcgttccgccactgacgtccaccgactacatcaacaccatcacgccggagcaggagccgtggttccccggtgacgagttcgtcgagcggcggatccgggcgtacgtccggtggaacgccgccatgctggtgcaccgcgcgcagcgtcccgagatcggcgtcggaggccacatctcgtcgtacgcgtccagtgccagcctgtacgaggtcggcatgaaccacttcttccgcggcaaggaccacccgggcggcggcgaccagatcttcttccagggccacgcctcccccggcatgtacgcccgggcgtatctggagggccggctcaccaccgatcagctcgacggcttccgccaggagctgagccacccgggcggcggcctcccgtcgtacccgcacccgcggctgatgccgaacttctgggagttcccgaccgtcagcatgggcctcggcccgatgaacgcgatctaccaggcgcggtacaaccgctacctgcacaaccgcggcatcaaggacaccagccagcagcacgtctgggcattcctcggcgacggcgagatggacgaggtcgagtcgctcggcgcgatcggcctggcggcccgcgaggagctggacaacctcaccttcgtggtcaactgcaacctgcagcggctcgacggcccggtgcgtggcaacggcaaggtcatccaggagctggagtccttcttccgcggcgccggctggaacgtgatcaaggtggtctggggccgtgagtgggacgcgctgctggccgcggacaccgacggcgcgctggtcaacctgatgaacgtgacgccggacggcgactaccagacgtacaagggcgagtccggggcgtacgtgcgcgagcacttcttcggccgcgacccgcgcacccgcaagctggtcgagcacatgaccgacgacgaggtgtggaacctcaagcgcggcggccacgactaccgcaagctgtacgcggcgtacaaggcggccaccgagcacaccggccagccgacggtgatcctcgccaagaccatcaagggctggacgctgggctcgcacttcgaggcccgcaacgccacccaccagatgaagaagctgacgctggaggacctgaagggcttccgcgaccggctctacctcgacatcagcgacaagcagctcgaggagaacccgtacctcccgccgtattaccaccccggcgagaagtccgacgagtaccagtacatgcagcagcgccgccgtgacctgggcgggtacgtcccgtcccggcgcaccagggccaagtcgctggcgatcccggactcgaaggcgttcagcgacatcaagcggggcagcggcaagcagaaggtggccaccacgatggccttcgtccgcctgctcaaggacctgatgaaggacaaggagttcggcgcccggtgggtgccgatcatcccggacgaggcgcggaccttcgggatggactcgctcttcccgaccaagaagatctactccccgcacggtcagacgtacacctcggtggaccgggagctgttcctgtcctacaaggaggcgacgaacggccagatcctgcacgaggggatcaacgaggccggatcgaccgcgagcttcatcgcggccggcacgtcgtacgccacgcacgacgagccgatgatcccgctgtacatcttctactcgatgttcggtttccagcgcaccgccgacgagctgtgggcggcggccgaccagatggcccgcggcttcctgctcggcgccaccgccggccggaccacgctcaacggtgagggtctgcagcacgaggacgggcactcgctgctgatcgcggccaccaacccggccgtcgtggcgtacgacccggcgttcgcgttcgagatcgcgcacatcgtcgagaacggcctgcaccggatgtacggggagaagcaggagaacatcttctactacctcaccatctacaacgagccggcgatccagccggccgagccggcgaacgtcgacgccgagggcatcctcaagggcatctaccggtacgccgagggcccgtcgacgaatggtccgaaggcgcagctgctcgcctccggcaccggcatgcgctgggcgctcaaggcgcaggagctgctcgcccaggactggggcgtgagcgccgacgtgtggtcggtcacctcgtggggcgagctgcgccgggacgccatcgcggccgaggagcacaacctgatgcacccgagcgaccagccccgcaagccctacatccagcagaagctggagggcaccgagggcccgtcggtcgcggtcagcgactggatgcgggcggtgcccgacctgatcgcccgctgggtgcccaacggctacacctcgctgggcaccgacgggttcgggatgagcgacacccggcatgcgctgcgccgccacttccacgtggacggcgagtcggtggccgtcgccacgctgcgcgagctcgcgctgcgcggcaaggtgccggcgcacgtgcccggtgaggccgccaagaagtacgcgatcgacgacgtgaacgcggcgccggtcggcgagaccggcggcgacagctgatcgatgggggcccgtcgccggggcggcgggcccctaccggtgcgtaaagtgcgccgcgtcgcataccggtggccggcctcggtagtctggggcggtgactgttcgcgtacgtttcgcaccctcacccaccggcatgttccacgtcggcggcgcccgttcggcgctgcagaactggatctacgcccagcagcacggtggtgtcttcgtgctccggatcgaggacaccgacgcggcccgcaacaagccggagtggaccgagggcatcatctcggcgctcgactggatcggcatcgagcgcggcacgtatgaagggccctactaccagtcctcgtatgccgctgaccacaccgccgcggcgacccggctgtacggcgagggcaaggcgtactactgcgactgcaagcgcgaggacgtgatcgcccgcacgggcaacacgcacaccggctacgacggcttctgccgcgaccgcgcactgggccccggcgagggccgtgcgctgcgcttccgcaccccggacgagggtgagacggtggtcgtcgacctggtccgcggcaagcccaccttcgagaacaagctgatcgaggacttcgtcatcgcccggtccgacggctcggcggtgttcctgctggcgaacgtcgtcgacgacatgagcatggggatcacccacgtgttccgggccgaggagcatctgccgaacacgccgaagcagcagctgctgtgggaggcgctcgggcgcaccccgccggtgtggggtcacgttccggtgatcgtcaacgagaagcggcagaagctctccaagcgccgtgacaaggtcgccctggagtcgtaccgcgacgagggttacctggccgccgcgatgcgcaactacctgatgctgctcggctggtcgcccaccggggaccgggagatcgtcccgtggtcggtggtcgaggaggagtaccggatcgaggacgtcaaccacgccccggcgttcttcgacgtcaagaagctccgcgcgttcaacggggagtacatccgggccctcaccccgagcgagttcacccagtgctgcgcgccgtggctgaccggcaccgagacgatcccggccccgccgtggtcgccggagaagttcgacgccgaggtgttcaccacgatcgccccgctggcgcagacccggatcgcggtgctctccgagatcgtggagaacgtcgacttcctcttcctcgacgagccggtggccgacgaggcgtcctgggcgaaggcgatgaaggacggcgcggccgacatcctggacggcgccgccgaggccttcacggctctgcccgagtggaccgcggagtccctcaaggcggccctggagcgggtgggtgaggcccgcgggctgaagctcggcaagacccaggcgccggtccgggtggcggtcaccgggcgcaccgtcggcctgccgctgttcgagtcgatcgagttgctcggccgggagcgcacgctggcccggatcaccgccgcgcgggcgcgtctttccgcctgatcgccctcttttaccgcattcgacggccgagcgccatagctggtcgtcgaatgcggtgatgcggtccgctacatgggtggccaccggccccgcgatttgcgggcagtgggtaatatctggccgctgatcaacggctttaccgtcctcggcggtcgtccccccacatggctccaattcaccctgccacgagatgcggcggggccggtgctcgggaaggctgagaggtggatgcacgagcagcggtccacgtaaccatgtcatccacgggcgggggaggtcggatggtggttcgacaagcgatgaaacgggtggccgcgggcgccggtgggctggcgatcgcggccgcggtgacgctgggcgtgacgcctggtgtggcgttcgccacaccgcgggcacaggccggcaccgccacgacggtggtcaccgggtccagcagcaagccggcgccgcagccggactcgctgctgatcaccggcgatcaggtgccgtcggagggcatcaaggtcctgcagtcggaggacccgaagctgttccgcatgatgctcagtgaggtgagctggctctcctcggccacgcccaccgccaccgagccgcagaagggcaagctcggcccgaagtacacggtcaaggtcttcatcaaggaggacgcctccgagctgtacgatctgtacccgctggccaccggcggcccgcgggcgcaccgtccgaccggcgcgccgaacggcaagaaggcggacggctggttctacggccgacagtcgatgtccgagtcgctgcgcctgagcggggtcccgctcaaggcgaagccggacgtggtcaacggcggcatcggcggcggcatcggggagaacctgaactcctccgagctcgacccggtctccggcgccggccacctgttcggccagatgcgccggctgctcctgctcaacggggcggtgctgctggtgatcctcaccggcctggcggggatggccttcgtgatccgccgccgcatctgaaacaccggcgacgcccgcaccagcgatgccctggccgcgattcttcgcgagccagggcatttcgctgtacgcgatgatcagcgccggtcgccggcatggtgatcagcgacacgttcgatgagcgccaccaggtcctccaggtccgcgtcgaactcccccgccccggggtccggggtgaccgtgggcagcccgccggtgacctccccggtggtgtagccgagcaggaacgcgcagatcatccgggccaggcggggcacctcggcggccggaacgcccgcgtcgtgcagcagcccgcgcagggccgcggtgagccacgaggccgaggcgccggccgcggaacggttcagcagcagcgggaaggcgctcgggtgggcgtgcgcgagcgagcggacggcccggcccagcgcgcgcagccgggcctgccagccgatttccgcgaggtcgtcgccgagcgtcgtgcccagctccaggtgcagcaggtcgaccaggccgtcgagcagggcgtccttgccacccacgtaggggtagagcgccatcgaggtgaggcccacccgctcggccaccgcccgcatcgacatggcggccaggccccgctcgtccaccagggcgagagcctggtccaggatcagccgtcgcttgtcgtccacgcgttcaccgtgaccacccggaccccgtcactgcgcgaaacgcgccgggccacggctcgcactcaccccaaaggggtgcatgctcgcggcgtaccgccgagtcgcgcgaagcgccggaaatcctctcagcaccagcgacccggggggcggccccggcccgcggctcggcggcgggggcggacggcgccgtgaaggtgggcgcccgcccagccgcgcaactcggtccggcaaccgacccggcccggctccgatgcgacgatcggctcctcctcggcccccggtggcaggtcctcaagggcgggatcgatctcggcacgcgtggtgtcgtcccgttccatcatctcccctcctcgatcctcggtatcggttgacggtcgcttgttcggcaccgtctcttcatcggcacgcccgggcgcgggttgaagcctccggtccgccagcacacgatgccaggtcaccgaccggaatcgcgggaggggcgcaccgctacaccgggcaaatgtcataaaaatactgaaaaccggcaaggttcgcgctcaccggaagcggcgtgacactctgggcccgtggccgagagccgaattgccgaacccgcgccggaagccccggcaaacccactccagcctgcgacgttacgccggatcgagcggcacgccggagcgctggccagctccgcggtggcccggatggaggaaacgctgccgtggttccgggcgctcccggccgatcagcggtcctgggtgatgctcgtcgcccaggccggcgtgcggtcactggtcgagtggctgcggtccggggccaccgtggcggccagcacccaggagatctccgacgaggtgttcgcggccgccccgcgcgcgctggcccgggcgatcacgctgacccagaccgtgcagctgatcaaggtgaccatcgacgtggccgaggccgaggtgcccggcttcgccgcgaagggcgagggcgacctgctgctgcaggcgatcctgcggttctcccgggagatcgcgttttccgcggcccgggtctacgcgcgggccgccgagtcgcgcggcgcctgggacgcccggctgcaggcgatgctggtcgacgcgctgctgcggggcgactcgtcggacgtgctggccagtcgggcggccgcgctcggctgggtcgactcgccgccggtcgcggtcgtggtcggccgctcccccggcggcgacatcaccgcggtgctgcacgcgctgtaccgggccgcccggcgcagccggctggaggtgatcggcggcctgcacggcgaccggctggtggcggtggtcggcggggcgaccgacccggtgctgaccgccgcctcgctgcggtccggcttcggcgacggcccgatcgtggccggccccggggtgccgacgctggaacaggccaccgagtccgcccgggccgcgctcgccggattccgtgccgcgccggcctggccgggcgcacccagcccggtcgcggccgacgccctgctgcccgagcgggccctcgccggcgacctggacgcgcggcgcaagctgcgcaacgacgtgtacggcccgctctcgcgggcgggcagcggcctgctggagacgctggacgcgttcttcgccgcgggcggggtgctggagagcgcggcccgggagctctacgtacacccgaacacggtccgctaccgcctgcgccgggtcgccgaggtcaccacgctctccccgctggacgggcgggacgcgttcgcgctgcggatggcgctgagcatcgggcggctggatcctgcgacatgagtcacaggggtcaagtactaacgaccagctcgtcaaatcgcccttaaacagctcaattcaacccctattttgtagagaacctacaaggcttgtcgtagggtttcgtcgcgcccggcaaccgcggaacgctccccgatccggaagagtcgaacacgtgctcgccgtactctcccccggccagggctcccagaagcccggcttcctggccccctggctcgacctccccggcgcccgggacagcctgaccacctggtcggcgctggccggcgtcgacctcgtccacctcggcaccgaagccggcgcggaggaaatcaaggacactgcccggacccagccactgctggtcgcggccgccctgctcgccaccgcccagttgccgctggagcaggtcgcggtggtggccggtcacagcgtcggcgagctcggcgcggccgccgcggccggcgtcctgaccccggccgacgccgtcacgctggccggcgtccgcggccgggagatggccgcggcctgcgcgctcgaaccgaccgggatgtccgcggtgctcggcggcgacccggacgaggtgctggccaccatcgagaaacacgggctgcacgcggccaaccgcaacggcgccggccaggtggtcgcggccggggcgcaggaggcgctggccgagttcgcggccgcgccgccggccaaggcccgggtgatcgcgctggccgtggccggggcgttccacacgccgtacatggcgcccgcggaaaccgcgctggccgaggtcgcgagcggcacagccgtcaccgacccggcccgtacgctgttgtcgaacctggacggcacggcggtggcgagcgggcgggagatgctcgaccgcctggtccgccagatcaccgccggcgtccgctgggatctgtgcatgcgcacgctcagggatctcggcgtcaccgcggtgctcgagctgcccccggccggcaccctcgccggtctggtcaagcgggagctgaagggcgacggcgcaccggagatcgtcaccctgaacacgccggacgacctgcccgccgcgcgcgatctgatcgcccggcacgccacgccccagcactgacgcgcgcagtcgcgaccgaaggaggaacaggatgaccgcgggttcccgcatcgtcgcgatgggccactaccagccctcgcgggtggtcaccaacgacgacctgaccaagaccctggacaccaacgacgagtggatccgggaccgggtcgggatcgccgaacgccgcatcgccgacaccgagacggtcgccgacatggccggcttcgccgccgagaaggcgctggccgcctccggtctgagcgccgccgacatcgacctggtcgtggtcgcgacctgctcgtcgatcgaccgctgcccgaacgtcgccacccgggtggcgaaccggctcggcatcgcggcccccgcggcgtacgacctgaacaccgcgtgctccggcttctcgtacgcgctgggctcggccgaccacgccatccgcgccggcgccgcccgcaacgcgatcgtgatcggcgcggagaagctctccgatgtcaccgactggtcggaccgcaagaccgcggtgctgttcggggacgcggccggcgcggccgtggtgaccggggtgccggacggcgaggagccgggcgtcggcccggtgctctggggctcggcaccggacaagggcgacgtactgcggatcgagggctggcggccgtacatcgagcaggagggccagatcgtcttccgctgggcgaccaccgcgctcgccccgttcgcgatcgaggcctgccggcgcgccggggtcgacccgtccgagctggccgcgttcgtgccgcaccaggcgaacacccggatcatcgacggcatcgtgaagcggctcggcctcagcgacaccgcgatcgtcgcgaaggacctggtcgagtccggcaacacctcggcggcgagcgtgccgctggccctgtccaagctgatcgagcgccgggagatcccgtccggggcgccggtgctgctgttcggcttcggcggtggcctcacctacgccgggcaggttgttcgctgcccgtaagatttgcccataaaccaccagttaacccgtttgagaggaaaaaacccaccatggctactcgtgaagagatcacctccggcctcgccgagatcctcgaggaggtcgccggggtgaacccggacgacgtcgccgagggcaagtcgttcaccgatgatctggacgtcgactcgctgtcgatggtcgaggtcgtggtcgcggccgaggagaagttcggcgtgaagatcccggacaacgaggtgcagaacctgaagaccgtcggcgacgccgtcagctacatcgaggcgaacgcctgacatgagcaccgtagacgtcgtcgtcaccgggctcggcgcgacgaccccgttgggcggggacgtcgcgtccacctgggacgccatgctcgccggccgctccggggtgggtccgctcacccaggagtgggccggtcagctcccggtccgcatcggcgcccagctggccgtcgacccgtccgaggtgatcgaacgggtccggatgcgccgcctggaccgcagtgaggccatcgcgatcatcgcggccaagcaggcctgggccgactccggcctggacggctccgggctcgacccggaacgtctcgcggtcagcttcggcagcggcatcggtggcgcggtcagcctgctcgaccaggacgacatcctggagcagtccggcccgcggcgggtcagcccgcacaccgtgccgatgctcatgcccaacggccccgcggcctacgtcggcctggagctcggcgcccgcgccggcgtccgggcgatggccagcgcctgcgccaccggcgccgaggcggtcgccctgggcctcgacctgatccgggccggccgcgccgacgtggtggtggccggcagcaccgaggcggtggtgcacccgctgccgatcgccgggttcgcctcgatgcgcgccatgtcgacgcgcaacgacgacccgcagcgggcctcccgcccgtgggacaagggccgggacggcttcgtcctgggcgagggcgccggcgcgctgatcctggagcgggccgaccacgcggtggcccggggcgcgcggatctacgcccggctggccggtgccgggatcacctcggacggctacgacatcgtccagcccgacccggagtgtgccggcggcatccgggcgatgtccatggcggtccgcgacgccggtctgaccggcgccgacatcgtgcacgtcaacgcccacgcgacctcgaccccggtcggcgacatgggcgagatcaagggcatcaaggcggccctcggcacgcacccggtgatcacctcgacgaagtcgatgaccgggcacctgctgggtgcggccggcgcactggagtcgatcgccaccatcctggcgatccgcgacagcgtggtccccccgacgatcaacctggacgacccggacgaccggctggacctcgacgtggccgcgcacaaggcccgcccgctcgacatcccggccgcgatgaacaactcgttcggtttcggcgggcacaacgtggcgctgatcttcacgcgtccctgacgtgtcgggccgggctcgcgagcccggccctcccatcttgaggaggagcccgtggaccgcgatccggaatcgcggctgcgcgccctcttcgaccaccacaccctgcgtccgctggccgtgccggacgactccggcgtgctgccggcgcgcggcacggtcgacggcactcccgcgatcgccttcgccaccgaccccggccggatgggcggcgcgatcggcgtccacggaagccggcgcatcgtcgaggcgatcgacctcgcggtccgcgaacgggttccggtgatcggcgtctggcactccggcggggcgcggctcgacgagggcatggtggcgctggacgcggccggtcaggtcgtcgccgccacggtccgcgccgccggccggatcccgcggatctcgctgctgctgggcccggcactgggcagcaccgcctacgtgccggcactcaccgacgtcgtgatcgccggcccggaggccgacggctcgccggccggcaaccggctgaccggcggatcggctgtcgccggtgcggcggccttcggccgggtcgcgcacgtgatcagcgacgatgacgaggccgcggtgggcgccgctcgccggaccgtccggatgctgggtcacccgggccggctgtcgccggccgacgtcaaacccggcagcacgctggggcggtccctcgactcactgctgccggccgggattcgcgggtacgacgtacgcccgctgatccgtgccctgctcgacgagcccggcctggaactgcaggagacgtgggcgcccaacgtggtcaccgctctgggccggttcgccggacgcacgatcggcgtggtggcgaccaaccccgggcatctcgatggccggctggacgaggccgccgccgacaagaccgcccgcttcgtccggatgtgcgacgcccgggcgctgcccctgctcgtggtcgtcgacaccccggggcatctgcccggcccggaactggtgatcagcggagcgcggctactgcacgccttcgccggagccgtggtaccccgggtgacgctgctcacccggcgcgcgtacggcggcgcctatctcgccctgaactcccgcgctctgggcgccaccgcggtattcgcctggcctgacaccgagctggcggtgcacgacccggtcgaggccgtgccgatccggcatcaccggcggctggccgcgacggcgcccgaggagcgcggcgcgctgcaggagcggctggcacgcgagcaggccgagaccgccgccgcgacggtggacgcggtgatcacgccggcggagacgcggcggcggatcgccgaggcattcgccgcggcaccgctctgacccctcacctccggcgacgccggcatccgatgcggctatctcccgcaggcgctgcggggcaggccggcgaccgcgatcggcgatctacccggtgccgtcgtcttcccggcgatcaccgcggccagcgccaccatcgacagccggctcgacgagtacgtcgccagcagcgtcggtgacttggcgtaggcgagcagccccggcaggtcggtgatcaccgtcagcgcggcgtccggggacaggtcgaccggctggtcgccgtaccccaccagccggatctcggccccgccggccgcctgcacgaccaccccggcgtcctgcagggcgtgcaccaggttcacccgggcggtctcccgcgaggccggcgcggtgaccgtgaccggcccggttaccagcggcccggagcaccggccgcgcagcacggtgaccgcggcggcgtccagcgcggcgaccgcctgctggtgcgccggcgtgccgatcgcggcgagggcgggtggggcggtggccgcggtgcggaacttgagggtgaggatccgggtgaccgcctcggtcagccgctgccgcgggagcgtcccgctcctcaggccggccaggatgccgtcccgggcggcgccgatgtccggcggcatgagcagcatgtcgttgccggcgttgagggcccgcaccgccgcctcgccgggcgcccacttgcgggccggcgccatgttcatcgcgtcggtgatcgccaccccggtgaactggagccggccgcgtagcacatcggtcatgatcttgtgggagaaggtggccggcacccccttgtcgaccgcctgcaggtcgaggtggccggacatcaccacaccggcgccggcctgcaccccggcctggaacggcggcaggtcctgggcctgccaggcggccaggctctgccggatcaccggcagctcctcgtggctgtccccgctggtgtgcccgtgccccgggaagtgtttgagggcggccgcgacgccggccccctgcaggccccggacggcggcggcgacctgggcggcgttcgccgccgggtcggtgccgaaggagcgggagccgatcaccgcgctgccggccggtccgagggtgtcggcgaccggggcgaagtccaccgtgacgcccatcgcggccagctcctcgccggccgcgtgccaggccgcctcggtcagcgcgggctgcccggcggcgcccgccgcgagcgccgacgggagcaccgtgacgccatcggtgatccgggtgaccaccccgtactcctggtcggtgccgatcatcagcggggccgcggcgggcagctgccgggcggccacctgcaggccgtcggtgagcgcccggacctgctgcgggttctccacgttcgaggtggggttggttcggccggtcgggtcctgctgggtgaacgagaccaggatcaggccgccgagccggtatttggcgatcatctcggccggggtgtcgacgccggccagtttccggttgccggccaccgcgccggcgtcgacccggttcgccgatccgccgtacgcgtacggcatcagcacctgcccggccaggtcctcgtcgctgagccgggccaccgtggcggccgcccggaccgccggatcgccgggtggcgcggacgccgattcggagagcgggacgctcagcaccgacccgaccggatcggtggtgggcggggcggccggcggtggcttggcgtcgtctccgcaggccccgatgagcaggagcagcggagcgacaaaagcgacacaagacaactttctcacgaccgccatcgaatcaggtcggacggcagcccgccacgcgatccccctacccgacccgggtgagaagggttaccggggcgccgtcgccggcgtaccggaacggctccagctcggcgtcccaggcgctgccgagcgccttctccagggcatgcgccagcgcctccggagcccgggcggacgccatgatggcacgcagccggtcctcgccgacctgaatgtcccccgaggcgcccatcgtcccgtggaacagcccgcggccggggacgtgcatgaagcgctccccgtccagccccggactcggttcctcggtcacctcaaaacggatcatcggccactgccggagggcagcagccagctcggcgccagttccggcgcgtcccgtccagctgcactcggctcggcgcatgctggggtcgaccggctgcacggtccagtggagattgaccggcgcggtcaggacgcgcgctatggcccattcgacgtgctggcacacggcgagcggggttgagtggacgtatacgacgccacacgttggcacggtgacctcccggagaccgaggtgcgtcttcccctacgacctcgaccgcggttgatcgtgtcccatgatgccggttggtacggatggtgcgccagagaatccgcaacatcgactgtgggaccggtcgtggtggcatacccggtccaacgcctgtacctgctccgacggcacggttcaccgctcgtcgtgtagagttgccacggccttttttctctgctcgagcttttcctcaaggagtaccgccgtggcgagcaacacctcaaagaccgcccgcgcatcagtccgcgccggccagggcaccggtggcgccctcagcgtgctcggtgagtacaaatacctcatcccgctcgccaacggccgcttcgcgtacgttcgcaacctgaccaacggcaagacctcgcacctcaagaccgactccgacgccttcgtcgaggagatccgcgtgctgagcgcggccggccacggcgccaagatccgcgccgagctgaacgccctgcacacctccagcccggccgacggctgggacgcgaccgagaagcggctggccgacgccggcgtcttcgagggctgacccaccgcgtacgagaaaggcacctccccggatctgccggggaggtgccttttcgcatctgatgaagatcacacctacaggatgatgaccgtgccggtcgccaggtcgtagacgccgccgaccacgtccacccggccctcggcgatcgccggggccaggctgtcggccgtccgcagccgctccaccgtgcgccgcacgtgggcccgcagcacgaggccggcggcgtccggggcggccagatcgatgccctcggtcgccgcggcgatctcgctgaccagatagccgacgtcgccggccggccgatccccggagcgctccgcgtccagggtggcctgcaccgcgccgcagttggtgtggccgagcaccagcaccagcgaggcaccgagcgcgccgacgctgaactccaccgaaccggccaccgagcggtccagcacgtgcgcgccggaccgggccaccaggatggagccgaacgcctggtcgaagaccgcctccaggggcacccgcgagtcgatgcagccgagcacgatcgagtgcggctgctgtccgccggcgagcgcgacggcctgtgccacgtcgtggccggcgagcggcgtgccggagacgaaacgcttgttgccggccaggagctcgtccagagcggcggcgggagtgaccggggcgggaagagtcgctgtcatgcggtcgattctcgtactccgacgggccgggggcagcgattgcgaggcaggtcacgtcactaacgggtcttccggccctggcgggaaagacggtggtcgtttcgccggagcgtgagtgatgattactacccgtgggtacgacggggccgtgagacacgcggaggtgcccatgtccgagcggatcgaggttcggctcgccgacggtgtgcggctgcacgccgaggtctccgggccggagcgggccccggtgaccgtggtgctgctgcacggctggtgcctggaccggcgcacctggcggcaccaggtggacgcgctgagcggcctgggccggcgggcgccgcgggtgatcgcctacgacacccggggacacggccgctcctcggccacccatcgccggtccgccaccctggaccagctcggtgacgatctggccgaggtgctgcgccggctggcgccccgcgggccggtggtgctggccgggcactcgatgggcggcatgaccatcatggagttcgcccaccggcacccggcggagttcgccggccgggtggccgggctgctcctggtctccaccaccgccgaggggcacacccacacccggtacgggctgcccgggagcgtggccggggtgctgcgcgtcggcgagaccctcggcgccggcgtgctggcccgttccggcgcctggcgcccgcaccgggccgtgctgcccgccctcgccccggcgctgcgctggctgctcttcggtgaccggtgcgccgacgaggacctgggcctgaccctgcgcggggtgggccgggcgtcgctgtgctcgatcggcgggttccgcgcctcggtcggcgcccagcagcggctggacacgctccacgcgttcgccggcgtgccggccgcggtgctggtcggtgaccgggaccggctgaccccgccggcctgtgccgagtcgatcgcggcggcgctgccggcggccgagttcaccgtctgcccgggcgccgggcacatgctgcccctggaacgccccgaggaggtgtcggcggcgctgctgaaagtggtccgccgggccggccgggcgacccgccggaccgccgccggtcacctcggccgcgccgcttagccggaacatccgcaccccgtccgtcgtttgtgagaggttcaaacgatgcggtgacaccaggccgcttcgacgcgcgttgccgggcaggagtacgttcgattgcccccttcgcgcgagcgctggtggtgcgcatgaaagggagaacgaccgacttgagcgacgccaccgtcctgcaacttcagatcgcggtcgagcagcagcacgtggaccgggtctacgcccggctcgccgagctgcgccgggacgcgtcccgggccgaaaaggagggctatcagctcgccggggtcggcaccttcggcgccctggtcgagcgggacgcgatggtgttccatgcggcccgccgccggcacgcgctggacaccgagtacgaggggctggtcttcggccgtctcgaccagaaggacggcgccacccactacgtgggccggatgggcatccgcgacgaggactcgaagccgctggtcgtcgactggcgggcgccggccgcggcggccttctaccgggccaccccggccgagccgctgggcgtgatccggcgccggatgatccagtccagccgggagcgggtcaccggcatcgaggacgacctgctcgatccggagtcggcaccgcccgggatgaccgtggtcggggacggcgcgctgctggccagcctggccaaggcgaccgggcgcgggatgcgcgacatcgtcgcgaccatccagcgcgagcaggacgaggcgatccgctcccccgcctccggcgtgaccatcgtgaccggcggcccgggcacgggcaagaccgcggtcgccctgcaccgcgcggcgtacctgctgtactccgaccgcagccggttcgccggcggcggcatcctggtgatcggcccgtccggcgtcttcgtcgagtacatcgcgaccgtgctgccctcgctcggcgaggacaccgccacgctgcgctccctcggctcactggtgcccggctgggacgcgacccgggtcgactccggcccggtggccgcgatcaagggctcgctgcggatgcgccgggtgctcgaacgcgcctcgcacgacgcggtcccgggcggcccggccgagctccggctgctctaccgcggcacgctgctgcggctgggcgcggccgagctggatcagatccggcgccgggtgctgcagcgcggcgcgcggcgcaacgaggtccgcggtcagggtttcgaccgggtcttcgacgcgctctgggcgcaggcacgtgagcagcgggtgaccggcctgccggagaaacgcgagttcgaggcggaactggccgaccggaccgacttccgggagttcctcaaggcgtggtggccgcgattcaccccgatgcgggtgctgcggtggctggccgatcccgcgcggctccggtcgtacgccaacaatctgctctcccgcgaggagatcgcggtgttgcagggttccttcgacggcctggccgagttcggtccgaccatcgccgacgtcgcgctgctcgacgagctggacgaattgctgggccgcccccggcagccgcagaagaagacgaagaatccgttccacgtgcgcgacggcatccaggaggtgtccaccttcgccgaccggcaggccgccgcgcgcgcccagcaggtgcagcgcgaggaggactaccgcgactacgcgcacgtggtggtcgacgagtcgcaggacgtctcgccgatgcagtggcggatgatcggccgccgcgggcagtacgcgtcctggacgatcgtcggcgacccggcgcagaccgcctgggccggcgacccggacgaactggaccggtcccgggagaaggcgctcggctcgcgcaagcgcaacagctacgcactgaccaccaactaccgcaactcgtcggagatcttcgcggtcgccgccggggtgatccgggcgatcctgcccgacctgccgctgccttcggcggtccggtccaccggcgtcgacccggtcgacgtggtcaccgcgccggccggtctgcccggcgcggtccgcgagctggccgagaaacagctggccgacgtcgacggcacgatcggcgtgatcgccccggtgccgcgccgcgacgaggtcgccggctgggtcaccggcctgccggaacgcgtgcaggtggtgaccgcgttggaggccaagggcatggagtacgacgcggtcgtgctggtcgagccgggccagatcgcgatcgaccgggccggcgtgcgcaccctgtacgtcgccctgtcccgtgccacccagcggctcaccacggtcggcacggatcccgcctggcacccctgaccggctgaccgaaccggtacatcacggcggcggccggccctcggttcggccgggctcgccatcgagcacgccaccctgccgggggaaccggccggcgccggccggcactgcgcgcccaccgcctggtgaccgggtatggcgatcatcacatcgatggcggatgatcgcgacatgacggtgctccatcagccgcgggtggcctgggacggtgctctggccatggtccgcgcttcccgggggcgggacttcctcgactacagctggcgggtccgcgacctgctcggccagccggtctacaccgagctggtggccacccgcgaccgcctggtcgcggccgatttccggaccggcggcgaccggtcgaccggggacctggaggcgggcaggtggcgggtgcgtctcgaggagctgctgcacgaccggcccgagttggcccgcgcggtcgtggaactcaccgcacgcgcccgggaagcctgaaacgccacttctgttctttttgcgatccgccacgccggatgcgcaaaaagatgagaatgcgaatcatgagtgacggccgggtcatggtcttcgcgccggccccacagctgacggtgaccatcgagcaacaccacgacgagccggaattgcatgtgcacccgggtggccagggcatctggcagacccggatgatcacgtcgctgggtgcccaggtgacgctctgcaccgcggccggcggcgaggtcggccgggtgctggccccgctgatggcggagctgcccggggtgaccatgcgactggtcggccgcgagcacggcaccgggtggtatgtgcacgaccgccgcagcggcagccgccaggagatcgccgagcgtcccggcgtgccgctctcccgccacgagctggacgagctctacaacctcaccctggccgagggcctgcgggccggcatcgcgatcctcagcggccccgcgcacccttcggtgatcaagcccgaggtgtacgggcggctcgccgccgacctgcggtccaacggctgccgggtgatcgccgacctgtgcggccggtacctggaggaggtgctcgccgccggcctcaacgtcgtcaagatcagccatgaggagctgatcaaggacgggctggccgccgacggctccacccgcgagctgatgaacgcgctcatgaagatcaacaccgacggggccgaggcggtgctggtctcccgcgccgacgagggtgccctggccctgatcgacgacgagatctacgcggtcaccctgccccggctgaccgcggccgagcaccgcggcgccggcgactcgatgaccgccggggtggccgccaccctggcctccggcggcacgctgaccgacgcggtccgcaccggcgccgccgccggcgccctcaacgtcacccggcacggcctcggcaccgggcacgtcgacgccgtccgggtcctcaccgaacgagtccggctgaccccgatcaagaaggcatcatgacgcttcgccaaccgcgcatcctgatcaccaacgacgacggcatcgaggcgcccggcatccgctggctggcccgggccgtcgcgcacgccggatacgaggccgtggtcgccgccccgctcagcgagtcgagcggcagcagcgcgtcgatgaccgcggtggtccaggacggcaagatcgtctcggagccgcgcgagctggtcgggggcaagaacatcccggcgtacggggtggccgcctcaccggcctacatcgtcctgctcgcgctgcgggaagccttcggcccggcacccgaactggtgctctccggcatcaaccggggtgccaacgcgggcgccgcggtggtccactccggcaccgtcggagccaccctgaccgcgtcccacgccgggctgcgcgggctggccgtctccctcgacgtgctcaccccggcacaggccaccgcggccagcggcggcgccgcgatcgacgccatccacaaggccgacgaggagcagcaccactgggcgagcggggccgagctcgccgtccggatgctgcccgccctgctgcacaccccgcccggcacggtgttcaatctcaacgtgcccgacctgcacgtggacgggatccgcgggctgaaacaggcggcgctggcccggttcggccaggtgcagatgagcatcgccgaagccggggacggcttcgtgcgcacggcggtccaggccgccgaggaggagctggacgcgggcaccgacctggccgcgctggccgacaacttcgcggtggtgacaccgctgcgggcgccgcacgaggacaccacgatccggatcaacgtcgacgggatccgcatccagaccccggcgatctgaccggcggtgcgcttcattggccggccctgccctgcatcagcctggtggcgcactgcaatcagcccggtggtccctgcatcagcccggtggtgcgcttcatcggcccggtggtgcgcctcatcgacccggccgtgccctgcgtcagcccggtagtgcgcttcatcggccgagaaaaagcccgcgaccggcggaagccgatcgcgggccagaagtatcggggtgatcaaccccacagcgtcccaggaagcagaacgtcaggcgccggagagcgccgcatcgtcctcgtgcggggccgggttgccgaacagacccagcagcccggtcacccacagctgccggtgcgcgaaccggctcggatgggtgacgacgaccttgaccccgccgaccccggcgagctggaaggccgccacgagcgcgctgatgcccacggagtcgatgaaggtcacgtgctgcatgttgagctcgatgcgggccggtgagccgtcggccagctgggccgcgacagcctcacggatctcgtacgcgttctcgacgtcgatctcgccgcgcggcgacacctcgacggcgccgtcagccagcgtcgacgtcgttatcgacagcgtcacgcctcttccctccacccgcccggatcgttccgggcgtttttcctctgtatcgcgggtcgtcacagcccaccctggagcagggcgggatggactacccccggaaggttcggtgaaactgaccgaaaggttaggccccgaacctgttagacacctgagtggcccgtgtgagcgaggtcaacagtactgcggccggtcaaatcgttttcgaaacgtgatgaggtcgggcccgacgtttgccgtttcccgcagcggggcaggagacgctccggggacaggagacggcgggttgggcgagcgcaggaggtaaccgaggatgttcgcgacgaggaagaaccgggcggaacggaccgcgggtcaggcctgggagtacctgtcggccgccgtggcgagcgccggcgagaccgccaaggaccaggccggtgaggctcgcaaggccgcccgccagggacggaaggcggcggccggcaaggctgccaaggtgaacaagcaggggcaccgggtcgccgacgaggcgaggtcgcgggccaccgccgcggccaacgcgctggccggccgcaagccgggtcgcccgtggggcctgctcgccgcgatcggcctgctgggcctggcggccggctgggccgcagccaccaccacccgggccgcgctggagcgtgaggcggagaacgagcagctggagctggccgagacggcggtcgtggtgacgcccaccgccgacaagtaggcgggcacggccgggcgggaaaacagggtagggcggccgggtccggccgccctaccctgttccgatggccgaaccgcagttcttcccggacgccgccgccctgcgcggctggttcgaggagcaccacgaggccgcgccggaggtcttcgtcggctactggcagaagggcgccggcgagtccggtgtcagccaccgagtccggtgtcagccaccccgagacgatcgagcaggccctcaccggcgcctactcatacgagcggaccgccccggtggtgttcgacgtcacccggacccgttgatccaggccacacccgccgccggggagtggttccgggcacagtcggcggcgtatggccgctccgccacgcgccgggtgctcggcgcccggcgcgccgacacccgggagcgccgcctcgcccagctcatcgaggatgccgcggccgggcgacgggtgcctccgctggcctcccgttgatccgcccggctctgtactcttgagcggcgttgcccacgatcaaagctgactcacagcttgcccagcggcccggccgcccgatctagagaaggtccacctggtgctcagtgcgggacacatcctggacaaccgctaccggttggacgagcggatcgccaccggtggcatgggtgacgtgtggcgtggcaccgacaaggtgctgggccgggtcgtcgcggtgaaggtgctgcgcaccgcgatgctggacgacccggagttcgccgcccggttctacggcgaggcccggatgatggccgcgttccggcacccgggcgtggtcgaggtctacgactacgccgaggccggtgactccggcggttcggagaccgtggcctatctggtgatggcgttcgtcgagggcgagccgctgtccgtccgggtgaagcagggcccgatcccggtggccgagacgctgtcgatcgtggcgcaggcggccgacgcgctgcacgccgcccacgaggtcggcatcgtgcaccgcgacatcaaaccgggcaacctgatcgtgaaaccgaccggcgcggtcatcctgatcgacttcggcgtcgcccggtcgaacgcgatgaccagcatgaccgggctgaacgcgatcgtcggcacagccctctacatggcccccgagcaggtggcgaaaggcaacctcacgcccggcacggatgtctacgcgctgggcgccgtggcgtaccactgcatcgccggccgccccccgttcgacggtgacaacgcgctccaggtggccctgcgccacctggaggacgagcccgacccgctgcccgaccacgtgccgttcgaggtccgggagctgatcgcccgggcgatggccaagcagccggccgaccggttcgccacggccgccgagttcgccgaggcggcctacgccgcggtcggcaccccgcaggactggaaacggctgaccggcactgcgatgatcgcgccgcgcagcccgatcccggtgagcccgccgccggcggcgcccacctacgcgatgacccgcccgcgcatgtcgccggcgccgccgccgatgccggcccccgagccggtcgcctccggctggcacacccagcggggcctgatggtcgccgtgatcgcgctgttcgtgctggccggcgggctgggcgtggcgttcgcactgagcggcaacggggagaaggcggacgcgaacaccggcggtaagaaggatcagaagccgggcatcagccagaccgtcgagcagccgttcgaccaggtgaccaacggcccgtcggcggccgagccgacccacaagccgtcggcccggcacaccaaggcaccggtgtcgagcacgtcggtctccgccccggcctcgtcggcgccggccagcgccggcccgaccagcgccccgccgtcgtcgaaaccgccggtctcctccccgccgccggatgatccgaccacgacgacgcccaccgccacgaccaccaccaccggtccggcggccggctcgcagtagggcgcggttgactctcacaccgtgtcagacgggatggtgaagcggtcatgttgagtatcggagacttcgccggcctgggccgggtgtcggtgcggatgctgcgccactacgacgccatcggtctgctgccacccgcccgcgtcgacccgcacagcggctaccgcttctacaccgcggagcagctgttgcggctcaaccggatcctcgccctcaaggacctcggcttcagcctgcagcaggtccagtcgatgatcgaggagaaggtcgacgtcggtgagctgcgcgggatgctgcggctgcggcgcgccgagctggccgcccaactggagcgggacaacgcccgcctggccctggtcgacgcgcgtctccggatggtcgagtcggagggtcacatggacaccacggacgtcatcctgaagcaggtcccggcgttgcgtgtggcggcgttgtccgccaccgcgctgggttacgaccacccctcgtcgatcagcgagaacctgtccccgctctaccctcgcctgctgcagctgatggagcaggcgggggtcgcgatgaccggctcaccgatcgcgtactaccggcccgcgccgaccggtcccgaggacgagacgatcacggtgcacgcggcgttcccgatcggcgacgccgaggtcggcgcggccggtttcgacgtggtgacgctgccgccggtccgggtggccgccgcggtgcaccggggcccgatggcggaagcgttccgcaccggtggacggatcgccgcgtggatcgaggacaacgggttccgcccggtcccgccgggttacgcgcgggaggtctatctgcactgcccgccggagctcgccgagtggctcaccgagatgcaggtgccgttggacggcaccggaaatgcaaccgagggcaactaatcctcaactgaatccggccccggccgatgaaggcgggtggcccggagattgcacccgggccgctacccgggaggccgcaggatgaccatccagacgtcgcatcacgatcacctcgtttcgccgccgtgggcgaatgagaatgccgtggaggcggcggagaccgtcgagttcgtcgtgccaccgttcgggggcaccgttccgccgtacgggtccccggagaacaagcacggcgcgctactggtccggttcccgcacgcggtgctgggtgaggcccggccggaggcgccgtcctggcgcccggtggtggcctggacgttcctcctgagcgtgctgggcgtggtgtcggccatgcggcgcgcgggtcgggccagggcgtacgggcggccgcgtgccccgtactggatcgccttcctgctcaccgcggcggccggagcggcgttctggtcggtgctggtcgccgacgtggcggtgccggcctaccggcaccacgtggaggaccgggcgaccgccgcggtgcaggccaaggtgctcggcgacggccgggtggaggcggcggtcggcaccacggtcaagtccggcggttgtgtgccggacggcgaccgtggcgccgacagcctgcgggtctacgtctgctcgttccagttgaccgacgggcggtccgcctcgatgcggatcaccgcggacatccgcggcaactggacgttcagaaagtgaccggcacgccctcgcggaccagctgccagttcttcacgaagaagtcggccgggtcgatcttgcccttggcctgcgcccagtcgatcagcagctggcggatctccttctgctcgttgtagacctgggtcttcacgatgcccgggaagttgccgccgcccgaccggcggtagttgttcaccgcgaccacgaactgggcgtcggccgcgacgtcgacgccggcgatctgcagtcgggtgatccggctgccgatcggcttgctgatgtcgatgtcgtagtcgaccccggagaggatgtcgtagttgtagtccgggatcgtgctgtcgctgatggtcgccgggtcgaccggcgcaccgacggcgagcgtcttgaagaacttggcggagtactccaggtacgccttcacctcggcgccggtcagtacgaccgcttccagggtgttgtcgtagatgtagagccccgcgaggtccttgatcttgacatcgcccttcgggaacaccgcggtccggctgaacggcgcggcgatcgagagcaccggcagattggcgtacgacgtgccggccagcgccttggtcacctcgtcggtctgcaccttgttgatgtagtccaggatcgcggtgtcctcgtaccgcgaggtggcggcggacagctccgcggtcgacgcggcgacgatctggttgacgtacgcgaccgtcttggcgtgctggctcttcaccacggccagcaccttcgggtcggcctcgaccgtgttggtgttcagcgtggccgacgccttgctggtgatcttccagcagccgtgctcgcggaccagctcgaagtccatcctggtgagccgctggccccacttggacggctccgaggtgagcacctgcgcgccggtcgccgtgttggtgacgaaccgctgcgcgatctccaggtgcgcatgcccgaacaggatcgcgtcgatccccggcacctgctgggcgatcagctgcaccgggttctcgttcggcagctccgggccgtagctggaggtaccgctgtcgccgccgtgcgccaccacgatcacgatgtcggcgccgcggtgccggatgatcggcacccacttcgcggcggtctccaccatgccgaggaacttcagcttgccctcgacgttgcccttgtcccagatcgccacgcccgggttggtcagacccaggatgccgacccgcagcgtgggcgcgtgcttgccgagcgagaccttcttgatgatgtacggggtgaacgccggccgaccggtcttggcgctcaccgcgttggcggccagggccgggaagcccagctgacggatccacaggttcagcagcggcaggccgtagttgaactcgtggttgcccagcgtgacggcgtcgtagtgcagcacgttcatcgacttggccatcgggtgccgctcaccggtctcggtgatcggctcctgcttggcgtagtacgtggccagcggcgtgccctggatggtgtcgccggcgtcgagcaccagggtggcgccggccgcctcggcgcgcagcttgttgatcagcgcggcggccttggcgatgccgacgtcgttgtgcgcggcgtcgtcgtactccgcgtccttgtagtagtcccagttgtagacgttgccgtgcaggtcggaggtgccgagcacggtgaggtggaacgtctccggggccttcggcggcttcgggtcgtgccccttgccgtgggcctgggccggaccggtgagcgccagcggcgccgcggcggcggccgcggagacggccagcacaccacgacgcgatacgccgttgggaagcgtcattgcgaacctttcgcggatgtctcgatacgcgtcgcctcgtgggcggcgcaaccacagcaccctaacggccgatcagcacatcggtcgatcaacggcaggttgcacgactgtcaagattgatcaaatctcttccggcgtctcgatgcccagcaggaacaatccggtgcgcagcgtccgcgcggtcaggtcggccagaccgagccggccggcccgcagcccgtcgggcgcccgcaggaccgggcagcgctcgtagaagaccgagaatgccgcggccagatcgtgcagatagaccgcgagccgatgaggttcggcctgctcggcggcggcggtgacggcgggggcgaagccgagcaacgccatcgcgagggcccgctcggccggctcggtcaccgccaccggccccggcgtgccggtcgtcttccggaagatcgaacacacccgggcgtacgccatctgcaagtacggaccggtgttcccggtgatcgcgagcatccggtcgaagtcgaggacgtagtcgccgcgccggtccccggacaggtcggcgtatttgatcgcgccgatcccgacggccggcgtggacgcccggctctccgcctcgtcgagcagggcggcgagcttcaccgtgtcaccgacccgggtcttgagcatcttgccgtccggtcccaggatcgagccgaacccgatgtgctcggcggtcaccccggccggcagccagccggccgccgtcgccaccgcgaagaccatctcgaagtgggtccgctgcggcgcgcccaccacgtagagcatccgccgcgcgcccagcttcccggcccggtaccggatcgcggccaggtcggtggcggcgtagccgtaccctccgtcggccttgcgcacgatcagcggcagcgggtcgccgtcgcgcccggtgaagcccgccgggaacgcgcagagcgcgccgtcgctctccgccagcaggcccttgacctccagctcggccacgacgtcgtcgagatcgccctgataccggctctcgccggcgaagtcgtccggaccgagcgtgatccccagccgggcatagacgtccaggaagtaccgctcggactgcgccaccagggtccgccacaggtcccgggagagcggatcgccggtctgcagcgccaccacccgccgccgggcccgcgtccggaagtcgtcatcggtgtcgaacttaacccgggccgactgatagaaagcggtcaggtcaccgatcgaatgatcggccgcaccgccccggtcgaccaggtgctcgaccagcatcccgaacggggtgccccagtcgccgaggtgattgacccgcaccacgtcgtgccccagccactgcagcatccgggccagggcgtcaccgatgatggtcgaccgcaggtggccgacgtgcatctccttggccacgttcggcccggagtagtcgaccaccacccgtaccggcgccgcggccggcggaacccccagccgggcatccgcgccaacggtctgcaacgcgtcggtcagcaggctgtcagaaacggtcaggttgaggaagccgggcccggagaccgcgatccgcgcgaccccgtccagatcggcccgggcggcgacgtcggcggcgatgtcccgcggcgcccggcccagttcccgggccagcgccagcggcgccccggactggaagtcggcgtgcggcgacgcccgcaccgccggatcgaccgggtggccggcgaccgccgccagcgcgggcgcgagccgatcatgcaggagagattcgagattcaaggtcaacacccgatttcttcgtacggacgaagcgggtcgaccggcgagcctctgcgcaaccggcgggatcgacccgccggaggtaggcacaagtcagcggcggccgtggagacggcggcgtcgcgagctgacggtgctgaacatgccgcgactataacccgccgcggccgccttggccgaccgggtagtgttccggcgatgagcgggacgaccggctgggaccaggacgccgccggcgtgctgcggctgccctccggccggctggtccgcggccgtggcctgcgccgggcgatgcccaccggccatcccccgcagttcggcgtctacctgctcggctccccgcctcccgagttcggctggaccacccgctggatccgctggcccgacttctggctgcccagcgaccggtccgaggcccgcgccacgctgcgggaggcgctggaccgggctgccggcgaacgcgtcgaggtcgcctgcttcggcggcgtcggccgcaccggcaccgcgctggcctgcctcgccgtcctcgacggcgtgccggccaccgaggccgtcgcctacgtccgcgcccactaccaccaccaggccgtcgagaccccctggcagcgccgcttcgtcgcccgcttcgccacggtcgcaccccggccctagcgcgccgcggccgggtcggtccggcgacgggccgtccggctgtggcgccggccgggtcagtccggcgacgagccgtccggctgtggcgccggccgggtcagtccggcgacgagccgtccggctgtggcggggccgggtcgggggtgccggtcgcggccgcctcccggtcccggttcgctcgcaggaactccagattgtcgcggtaggagaagaaggcgaggaccgccgagacggcgccgagcagggcggcgatgacgctggcgaactgatcggcgcggttcgggccgaggccggccatcacgacgacggcgatcgccagcaggaccagcaggccgaggccgacggtctgcagccggcggtcggcggtgggcggggacaccggctcggcgggcggtttgtcacggtgggtgtaccaggagacgccggcgtcgatcaggacgatcaggacgatggccgcggtcacgaagaccggtaccagccaggcctgcaggccaccggtggtcatcgcagggcctcctgcatgctctggacgaagttctcgccgagctggatccggttgtagaggtagttgtagacgtgctggcggacgatgccggagaaggccgcgtaaccggcgctcatcgggcgcgggtgggcccgttccaccgctgagcggaccttccccaggtgcgggaccgtggcggccagttccgggtcgttgtacgcctccaccgaggtgggcgcgaaaccgtaggtggccagcaacttctgcgcgggcatgccggtcaggaactggatcaccgcttcggcctcggcccggtggcgggtgtcctcggcgaccgcgagggcctggccacccaggatgccgatcggcagcgcgccgaggcggatcgccgcggtgccgggcttctcccgttcggcgcggtcgatcgccgggaagtagaccggccagttccgcatgtaccgcaggccctgccgctggaacgcctcgttggtctgcgtctcgccggccgtgaccacgacccgccggctgtagatcgcggcggcgagcggggcgagcgccttctgccactggcccaggttgaacgagaccgtgccccggtcgtcgaggatcgtcggatcctgggcgagggcctgctccagcacgttgaccacgaacgcctcgtcggtgaacgtgccctcggtgctgagctggccggtgaacagccgggtgccggcgatcaccgcgtccagaccgggttccaggtcccgggcgcccttcgcggcgatccggcggtagagcatgcccacgtcggtgttgaacgggaccgcccagagccgggtcgagccctcgatctcgcaggtacggcgcaccggcggcagcagggtgatgccgtccggcgcgtcgatcggcgtgatccggccgctaccggagaaccgcgggatgtggatgatgtcgaggttgtagatgtccgccttggtgctgacgaacttctcgtactggtcctgtgtggagttgccgaccgggaccacctcgacggtcacgtccggatggaacgtgttccacagcttgatcagcagggtgcgcccgccggtgtcgtcggtgccggtgaccagggtgagggtcaccgggacgcggcgggtgaacaggtagccggcggcggtggagagcatcccggcggtgagcaccccggcgatgaacgaccgccgcgagtacaggtccgtcatgtgattcaaattactcgatgtacgccatcgcggcgtacccggtgtgcgaggcatgtgtaagttaggtgaccgcctatatactcctcgtgagcgacctgccgtcgaccgccctggcgctgggagcaccgcttgtcggactattactttttcctcagctacgcgcgcggcgacgactgggaatcagtcaagcagttcttcaacgatctgtccgccgaggtccgctcctacgcggggctgccgaccagccggaacgtcggttttctcgacgtggagatgcaggtcggcgaggcgtgggcgcggaccctggtcaccgcgctcggcaactgccgctcgttcgtcgccctgatcacgccgcgctacctgcagagcgagccgtgcggccgggagtggacggtcttcaccgagcggctgaccctgctcgaactcgacgtcccggtgctcgacccgccgccgctgatcccgctgctctggctgccgccaccaaaactgccgccggccatcgcggcgcggcagtacctcaaccaccggctgcccgaggcgtacgcggcgctcgggttgcgccagatcatccggctgcagcggtaccgggacgactacatcgagatggtcgcccgcctggcccagcagatcgtggcggcctacgacgtggacccggcgctgccgaagaatccggccacggtgccgttcgaggagatccccagcgccttccacaccgccgggatgacgccgccggccaccggcgggccggcccaccaggtggagttcgtgatcgccgcgccgtcccgggccgacctgagcgaccaccaccatccggacctgccgggcgtggcccgggacccgcgcttctacggcgaggcgccggagagctgggcgccgtaccggccggccctggagtcgtcgctcgccgaccgggcccgcagcgtggcgttgaaccaccggttccaggccctggtcaccgatctggacaagctgcgccggctcggccgggacgacgacgcggtccggctcgtggtgctgctggtcgacctgtgggtgaccggcctggcccggcatcgcgaggccctggcccggttcgccgccggcggccgggacaccaccgcggcggccgtgctggtgccggccggtcaggacgacgagcagaccctgacccacctgcatcagctgaaggcgacgctgagccgggtgttcggccggcggatgaacacccggatggacccgcccgagttccgcagcgagatccccagcccggcggtgttcgacgccgagctcggcggcatcctggagcgctcccgcaaccggatgttccgcaccgacccggtccaccgccgcccgcccggcccgtccgggcagcggccgattctgcgcggtccgtgacctccagaaaggagtccggccatgaccagctcgtcccacggccgggagcccggtcaaatcgtgacgttctactccttcaaggggggcaccggccggaccatggcggtggccaacgtggcgtggatcctggccgccaacgggttgcgggtgctcgccgtcgactgggatctggagtcgcccgggctgcaccactacttccgtcccttcctggccgacaagaagctgcggcactcccgcggcgtgatcgacatgatccgtgacttcgcggccgcggcggtcgatcccaccgccgatcccgccgagccggagtggtaccgccgctacgccgacgtggagcgcgaggcggtctcgctgacctggcgtttcccgggtgccggccggatcgacatgctgccggccgggcagcagaacccggcctactccggcacggtgagcaccttcgactgggcggcgttctacgaccggctgggcggtgaggccttcctgcacgcgctgcgcgagaacatggcgcagatgtacgactacgtgctgatcgacagccggaccgggctgagcgactcggccggcatgtgcacggtcaacctgccggacacggtggtcaactgcttcaccctcaacgagcagagcatcgacggcgcggccgcggtcgccgagtcgatcgtccggctcagcacccgtcgcccggtgcggatcctgccggtcccgatgcgggtcgaggacgccgagctgttcaagctggagaccggccgggaccacgcccgccagcgcttcgagccgtacctgcggctcgacccggacgcggccacctcctactggggcgacgtcgaaatcccctacaaacccttcttcgcgtacgaggagatcctggccaccttcggcgaacgtgcccggcaggaacactccctgctctcctcgttcgaacggctcacctcgatcatcaccgccggtgcggtgaccgaactgcccccgatggaggaacgggaacgccggcgctggctggccggcttcgaacgacagaagccctcgatcaacccgaacaccgtgatcagctacgtctcggtcgaccgcacctgggccgactggatcgccggcgagctggagcagatcggccagtcggtcacgctgcaggaggtggagctgaccgacccggccgccggaccgggccacgacccgcgcccggccgcccggctgctggtcctgctctcccacgactacctgctcaccccgcagtccgcggcgctctggcagcaggccgccgaccgggacctggccgctggcgacctggtccggatccggatcgacaacagccggctgccggtctcgttcgccaggccccaggtccgcgaggtggacctgttcggcctgaccgaggagcaggcccggccggccctgctcggcgcgttcgaccagccgcacctggagccgggcgccgccggtgtccgggccggagcgcagtccggatcccggttcccggcggacactccgccggtctggaacccgccgcagcgcaacccaaccttcaccggacgcacccggctgctggaggaactgcgggaccgcctgccgatcagtgtcaccgcgaccgcgccgcaggccctctacggtctgggcggcgccgggaagacgcagatcgcgctggagttcgtgcaccggttcgcggccaactacgacatcgtctggtggattccggccgaacagcccgccctggtccgcgcctcgctggcggagctcgccgaggcgctggacctgcccaccgcgtcctccacggccgaggcggtcgacgccgtcctggacgcgctgcgccgcggcgagccgtaccggcgctggctgctcgtgctcgacaacgccgaccagccggaggagatccggcgctacctgcccgccgggcccgggcacatcctgatcaccacccgcaacgtggcctggggccggtacgtcagcgccaccgaggtgccggtcttcagccgggtggagagcgtcggcctgatccgccgcctggtgccggcgatgtccgaggcggacgccgagatgatcgccgccaaactgggcgacctgccgctggtcatcgagcaggcggccgcctggctggcggcgaccggaatgccggccggcgcctactccgcactgctcgacaccgagctcccccggatgctgcgggagaacccgccaccggggtacgagcacaccccggccggcacctggcgcctgtcgctggaacgcatccgggccgacctgcccgccgcggcccgcctgctggaggtctgcgcgttcttcgcccccgagccgatcccgatgcgcctgctgtacagcgggcggttcatcgagctcctgcagccgctcgacccgaccctgcaggacccgctgctgatcggccgcctggtccaggagatcgggcggtacgcgctggcccgcttcgacgccggccggaacaccatcgcgatgcaccgcctggtgcagaccttcatccgctccgagatgtctccggaggaccgcgagcagaccggccgggacgtacaccggatcctggcggcgaccaacccgaaggagccggacgacccggagacctggcccgactaccgcctcatccgcccgcacatggaggcgaccggggtgctcagctcaccggtggccccggtccggcaactggtcatcgacatggtccggtacctgtggcggatcggcgacctgcaggaaagccaggaactgggcgaacgtgcgctggccgcctggcgtgcggccggcggcgaggacgatctgacgacgctctggctgcgcctgcacctggccaatccgatccgctcccaggcccggctcgccgaggccctggcgatcgatgaggacgtccaccggtcgctgctgagcacggtgggaccggagcatccgtacctcgtgatgagtctcagcggacgggccgccgacctcaagggcctcggccgctacccggaatcgctcgccctcgaccgggaggcgctcgcgctggccacccggactctgggcgagaacgcggcgcgcaccatcttcgcgatgaacaacctgggcctgtcgctgcggttcaacggcgacttccgggagtcggcgaagatggcggagcggtcgtacgtgctggcccgccagctcggcgagagccgcccgtacaccctggcgatggccgccaatctcggccgcagctatcgggacctgggacagttcgccgaggcccagcgggtgctgacccgggtgctgatcaagtcgaccgaggtgcacggcgcgggccacgcgcagaccctggcgatcgtccggatcctcgccgtgaccctgcgcaagctcggcgacctggatcaggccgaggcactcacccgggacgtccggccgaaactggagcggcggctgggacgcagccacccggagaccctggcctgcctcaacgacctggccaacctgcagtccgcgctcggcgacgaccggaccgcactgctgaccgcggagaccgcgctgcgacactacgagtcgcggctcggcgtcgaccatccgtcgacactggcctgccggaacaacgtggcgatcttccagcgccggctcggcgaccacgccggcgcgcgggagatcagcgaacgggtgatcgcccggttccgcgccctgctcggcccggatcatccgtacacgctggcctgcctggtcaaccggggcaacgaactgttcgacggcggcgacctggacggcgcccgggacaacgatcaggacgtctgcgaccgcctgaccgaggcgctcggcgaggagcacccggacaccatcgccgcgcgcagcaacctggccatcacgctggcggcgcgcggcgaccaggagacggcccgcgagctcacccgtcgggtgctcgctcagtccgtgcgggtgctgggtgccgagcacccgaacaccacggcgatccgcgagggccggcgactgaactgcgacatcgacccaccgcagatgtgactagccgacctcggcgggcaatgcgcggcgcaggtcggcgaaaacccgatcccggatgtggtcgatcagccggcgctggtccgcgcagtagacggtcgggttggcgaagtcggcgggcgcccggaaccggtgcgcatagtgcccgccgccgcagaccgcgaccgccgggcagcgccggcacgtctcggccaggctcgccagcccgctctgccgggcccgcacgccgggatgcgcgagcgcctcgtcgagcgtgtggtcgaagacgttcagcccggtcgcggccgcccggtcggcggtggtcttcagcgcgtcggactgctcgatcgcaccgtcggtctcgatcgtcacgtagtccaccgggtccagcccggtcgcctcgtagccgctcgcgccgcccagcagcaacgtgatgatcgagctgaacagccggatgtcggtctccggcgctgcggagtaccaccggtcgaagacggccacgagccagtcgccgtacggcgtggccgggtcaccgggcacccggaacggcggcgggctcgtccagttgccgtgcggcagcagcagatccatggtcggcgggccgagcgccagcagcgcctcgtacacctcgaccgggtcgttgcggacgtcgatcgtgcacagcaggccacggtagagatgccggtaccgctcgccgcggagccggtccaggccggccacgacgtcgtcgtgactgcccgcaccatgcgcgtaccgccgatgccggtcgtgagccgcccggccgccgtcgacgctcaccccgacccggacgtcgtgtcgcagcagcgcctccagcatcggctcgtcgagcaggatcccgttggtctgcacggtgaaccgggccgcggcggtgctgcccagcgcctcccggatcgccccggtgaccgtcccgatcgccgcggcgccggccagcagcggctcaccgccgtgcaggaccaccgccagcgagtcgatcccccaggcgcgcgcatgctcggccacccgggccgccgcggcggcgatcacctcgggggacatcacccggggacgggtgcgccaggactgatcggcgtgctcatacacataacagtagtcgcacgctaaattgcaccggctgtgtagtttcagaagaacttgccggaatggccggaccggccccgcggccaccatttcaactgacgaagttggtgaagtacgtcgttgtcggttccgggtcgtcggcccgatccaggagggccagcagaacccgactgtcgaccttcgaccgatcgaccagtttgcgcgtgctgttcgtgatgacgtacgggtcgtcgtcaggctgcacagccggcttcattgccacccctctgaataatgcgggggaagcgtagcatccaggccgccgccgaacgcacgaaacgaccagcctgtggacaagttcgcctaaccgggaacgataattgcactcccaggtttgaggtaagtgaccagtgctaccggaagtagccgggtcgtgtcatttccgagaccggacgatatcaggtgctcagcggctccaggtcgaagaaggcccgcccgccggagcgcagcgccaccatcagcgggtgtttctcgtcgaacagctccccggcgatccggagcacctcctcgcgctgtgcctcaccgccggtccggtcaccggcggccagccggctcgccaccaggttgacgccggcggtcaggatcgccggatgactccggctgtgcagtcgctcgcgcaaccgggccaggctgaccgtgtccgcttcccgagcggcctgcacctcaccggcctggaacagggcgctcgccaggttcatccggccgatccagacgtacggatgggactcgggcagggtggcctccaacgcggtgaacgtctgctccagccgggtgcgggcgtccgccacctcgccgtccaggcattccaggaccccgaaggtgttggcgacggtcagcgtggccgggtggctctccccccggatccgggagtagccggccagcacctcggccgcctcggcccgcgcctcggcgtgctcggactgggccgccctgatgttcgccacctccagccggcaggcgagcgtgtgcggatgctcggcgccgaccgtcgcgccgaaccccgccacggcccgctcggccagctcccgggcctcggccaggtgaccgaggcggcgcagcgtgacggcgagctccttgcgggtcagcagggtgtactcgtcggcctcgtcgagcgcgttctgacacccggccagggtttcccgcagcacgttctcggaccggcccaggtcaccgtcggcccgcaggcaccggcccaggttgcggcggatcagcagggtccaccgggcggacgggccgagcacgtcctcggaggccaccacggcctgctcgctgatctcccgggaccgggcgaagtcgccggcgagcatcaggaagaacgcgtagttgttgcgcgcgatgacggtccggcggtggctgtcgccgaccgtggtctgccagtgcagcagcacctgctcggcgaggtcgaccgcctgctggtactgcccgagcccgacgtacgccgcggccacgccactgagcgcgatcagcgcatgcgggtacgtgtggccgcgctgggcgatcatccggtccgcggtgtcctgctggatgtccaacgccgcgcggtactcgccgtgcgcctccaggatgttgccgagttcgctgcgcatccgcagcagggagaggtggtcggcgccgagccggtcctgccagatcccgatggcccgctcggcgagccggcggccaccggccaggtcaccgcggtaccgcagataccgcaccatgtcgacggcgagctggtgcacctcggcgtcgtcggagtcgagcgcgccggaaggctccaggtgggtcaggatgccctggtacgtcggccagctggcctggtcgtcaggttcgccgcgctgagccttcgccaggatcacgtgtatctgctcccgcctgcgcctctgctcttcaacggcgaggtcgctgataatcacactctgcaccaggcggtgcatgcgaagcgcgtgaaccgccgaatccacccgggccaacccgaaccggctcacttcccgcaccaacgagttgcgcatcagttggtcacggaagatcgggtcgtatctcgccagcgcgtcggccatgcccgggctgtccagcagcgtggtggggatcggctcgggcgccatcacggccagcagctccaccaggaacgcggcggccgggttcgcctgctgcagacgcccctgggacagccgccaggtctcggcggccgggtgccggtaaccgggcggcggcggctcgttgaggatgcgcggcagctgctcgtcgagcagcgcgaggtaccgttcggcggacatgccggtggtggccagccaggtggctgcctgttccacggcgagcggcaggtcacccagcttggcggcgatctcgtcggcctgcgcgtcggagagaccggccacccgccgggtcagcagggcccggctctccgagcggtcgaagacgttgatgtccagcgtccaggcggtgcgcgaccactcctgcccgggcgtggtgaccaccacgtcgcccgacccggtcggcaggaaccgccggatctgctccgggtcctcggtgttgtcgaagatgacgatccagttcgccgacgggttgcccacccgcagcgcctccagcacggcggccacctcctcgtcggcccggccggagccggcgatcggcaggccgagctcccgggccaggtcggccagggcggtgacgaccagcgccggctggtcggcggagatccaccacacgatgtcgtagtcggcgttgaaccggtgcacgtactcgacggcgatctgcgtcttgccgacgccgccgatgccctgcagcaccaccgggccggtctgcgcgttgctggcgttgagctgctcgcgcaacgcctccagggtggcgtcccggccggtgaagcccgggttgcgggccggcgcgcgccagacccgggccggctcgaacgggaaccggggggtgggcccgccggcgaggccgccgatgtgcccggacccggtgtcccgcaggtcgagccgggccagcagcgagtcccgcgccgcgcgttccggcacgttgaacatgtcgaccggctcccggtcggcgaacggctcgggcgggcggaagccgtccacccggaccgggacgaggaaccggccgtgccccgggatgtcgcgccggacggtcagccgccaccaggtctccagctggggcacccggaccgactcctgggagagcaggacgatcgcgcagtccgagcgggccaacacctcggtcgcgtccaccgcggcgttgacgtcctgcagcacgctgcgctggccggccaggcgcagctgataggcgatccactcggcccagatccggtcccgcggggtgtagcagatcagcgccggccccgggttgatcgtgccgcgctgctcgaactccgccagccagccgagccggatcgcctcggagatctcgtccagcttgcagcgctcgccgacgagctcgccggccagccgttcgtacgcggcgagcaggtcgttctcctgatacggccggtcgccgaaggtggcgagggtctcctcgtacgcgtagaagggtttgtaaggttgttccacctgaccccagtacttgccggggtcggcgtgcccgagcgccgccacgaactcgcggaactgttgctgggccagcgcccggcggcggttcagcttggccgcctcgccgtcctcgacccggctcgggaccggaaagatccggatgtcgtcggggcgcagccggcggatcgtgttcgccaccgcgacggcgccctcgatgctctggttgttgtaggcgaagcagttgaccaccgtgtcgggcagggtcacggtgcagatgccggcgttgtcgctcaacccggtgcggctgtcgatcagcaccacgtcgtagttggcgcgcatgtcgtcggccaggtcgaagaggaaccgctcgccgttgagccgggtgtagaacgtctcccagtcgaagttgctgaccacgtgcgagtactcgggggtctgccggccggacgggacgaagtcgatcgagccgccgcgcgggaattcgtaccgctccagggaggtcgcgtactcctggatccgggccagccggcggatctccccgggcccgagctcctccccgttcgcctgcgcctcgccggcccgctcctcgaaccggacgaccgcgtcgatcaccccgggtgactggcgcagatcgcggtcgggcaggaagggcgagtagtaccggtgcaggccgggcgactccagatcccagtccacggtgagcacgcggcgtccggtgctggccaggatccaggcgacgttggccagcgacatggtccggccgacgccgcccttgaacgagtagaacgtgatgatctgtccgtgccggcccgagaactccatgatcaccgccagttcgtgtgcacgttgcgccggaccgcacggtttcccgcgggaacgtacgtccgccattgtcccgcgccggtcaagcgcgtcgtccccggatccactgtggccggcgtggtcacggcccctccagtaccggccggcgcggcccggggcgtgacccgcccggccgctcgcgccggtacgcccggcgctgcgccgcggcgatcgccgtcgccaggtcggcgtcgaactcgtcgggtgagtcgacgccgacccggaacagcgagtcgtgccaggacgcccggccggggaagctgcgcagcacctcgccgcggagctcgccgcgccgggccgaggtctccccgtcgcccgggctggccgggacgagcaccgccaccgcctcgtcgtcccgctcgccgatctcccgcagcgcccggtgcagatcctccacccgggtggcccaggcgtcgacgagaagcaccaggatgtcgcgctgcagccccttgcgcagccgctcgggcaccgactcgatcggtaccacctcggactgcaggcggcgatcggagaccaccccgcaggcccgggccgccagcgactgcggggtcatcggctgatagggcgaccagtcctcccggcgccggccgtagaagcgcaggtcgtcgcggaccgcccgcatctgctcgcgggtgccggccgcgaccaccacgtacaccttggtcgacggcgggccggcgcccggccggtggcggcgctcgtcgaacgggttcaccgcggcgtccaggtcgacgccggccgggccgtcgggcaaccggtgcgcgtgcgccgtctcgaccacccggtgcgcgagcgaggccacgaacgcggcgtacccggcgcggtgcgagcgcaggcgcatcatcacccgcaggtcgtcgccgtgcggcgtccgatggggctggacgtcgagccccggctcgtggaagacgtcgccggaaacgccgtcggccgaccacagcaccgggatcagcgcgccggaggcggccgccgagtcgtccttgcggatccggtcgacgaaggtgccccagtaccgcccgcagcggtcgctggccaggtagcgcgacgagcacagggcgatgaaggtctggcaggtgccgagcgcggaccgggcgtcggccggccatctgccgttgccgctgtcgtccagatatccgatgacctgctgaggctccgcgccgatccggcgggcgatctcggcggacagatcgcggtagagccggcggacgaagatgtcgtcctcgtcagacgcgtagctcagaaagaaatacagcatccggcctcccgacggccaccgacgggcccagcggtcgcgcgggtcacctctgggccggcaggcggccgccccgtgcgggctttgagtcattactaccgcaccgagcacccgagggatacccccgggacggacgtcaactccggacacccgggcctccggcggccggcgggagatcggtggccagccgatcggccgcgtgccggatcagcgtggcgagatcggcgcagtacaccgacgggttgtcgaacccggtcagcgagctgtatcgatgggcgtacagcccgccgccgcacacctccaccagcgggcaccgccggcaggtggcgctcagcccgtccacaccggactgtcgggcccgcgcccccggatgctccaggtaatcgtcgaaggagtgccagcgcacgtgcaggccggtggccggcgcgcccggcgcggccgtcttcagcgcgtcgccctgctccagggtgccgtcggtctcgacggtgaccaggtcgacccggccgagaccgagcccctcgatcccgcccggcccgccgagcagcagcgagaccagcgactcgaacagccggacccgggtctgcggggccggcgactcgtaccaccggtcgaagatcggaatcagccagtcggcgtacggggtgcggcccggatccgggccgcgctccggcggcgggcggtcccagttcccgtgcggaagcaggaagtccagctccggcgggtcgaacgcgagcaggtggtggtagacgtcgagcggatcgttcgtcacgtccaccgtgcacaggatgccgccgaacagggggcggtgccgcgcctcgttgagccggcgcagggccctggccaccccggcgtgactgccccggccgttcgggaagcggcggtgccggtcgttggccgtcgccgggccgtccaggctcaccccgacccggatccggtgggtggcgaacagctccagatacgcgtcgtcgagcagcagcccgttggtctgcaccccgaacgcgaccttggtgtggctggtgatcgcgccgcgcaccgcccggacgatgtagtcgatcacgtcgggcccggccagcagcggctcaccgccgtgcaggatgacggcgagatagggcaggtcgtgcttgccggcgtgctcggcgatccgggccaccgccaggtcgatgtcggcccgcgacatcacccgcgggcggtcccgccagctctggtccacatgctgatagacgtagcagtagtcacacgccaggttgcaccggctgtgaatcttgagcaggacctggcgcaccggcgctggtgcgaagcccgcgggtcggctcacccctaccggggcgcctcatcggagcagtggcccccgatgaagttcccgaagacgcccgcgtgccgcgactcgtccagcgagtgccgcaacgccgggcgccgccgcagcagcagggccagtcgcgcctgatccggcgcggccgaacgtagcagggcgatcgaagtctcactctcacgtgccatgccacaaacctcgcatcgacgacggggcgtgatcttgcggggcgagagccaccgtaacgctatcgtagagcgtcgattcgactacgtacagtgtcgccgactacgtacagagtcgcccggctccggcggtccggccggcggcacgcggtgcgcggccagccagtcccgggcgaaggccaccgcggccggcagcgggaacagccgggccaccgcggcaccggccggaccggtggtcaccgcgccggtccgctcgaagtcggcacccagggccgcgaagtcgccggcgtcgagcagcacgccgcgatacggcacccaggcgcggccggccggggtgctcatcacgcaggcgttgtcccgtggggtgcgccagggcaggcggtactccgccaggtggaacgccgtgcagcggtcgaagccgacaccgagcagcaccacccgggcaccggccgcctccagcgcggccagcggcgactcctcccccagttcgctgaccaggtcgtgccggcgcatcagggccgcggcccgggcgccgaccgccgcgaacgaggtctgcgggtgcgggctgcgcacggcgcccggccagcagcgcagggtctcggccacgatgccgagcgcccggcacggcgtgcgctgcgcgtcgtacgcaggcatggtttccctgatccgcggccaccaggccgccgggatctccggaccggcccagcgcgccgggtcgcggttctcgctggcgaacgccggcgtcacgagcgtgccggcgggacccagcacgtcgaggaaggcctgcacgacggtgaccgcgccgccgcagacccagcccaccgacctcagcgaggagtgcaggagcacgctctcgcccgcgcgcagccccagcccgcgcaggtcctcggccagcgagccacgatccgcgaagtccatcactccttctaccaccaccgggtggcgccgatcactggtgacgccaccccggccggcgcgcgtcgcggcaggagaaggctgtaggcatgtgtgctgcctgcggccagaccgcgcatgtgcccgacacaccccgccggttcgccgcgctgcgcaacccggactgccggccgtacctgttcggcgccgcgctggcgatgatggcggacaacatcgagcacgtcatcacctactgggtgctgtgggagaagttccactcgtcggcgctggccggcttccaggtgatcagccactgggtgccgttcctgttcctgtcggtctggttcggctcgctcgccgaccggtacgactgccgccgggtgatccaggtcgcgcagacgttgttcatgctggtctcggcggcctggggggtgctcttcctgaccggcacgctgcaggtctggcacgcctgcgtgctgctggtgctgcacggggtggccggcgccctgtggggtccgggcgaacagctgatgctgcacgacttcgtcggcgacgacgaactgcccagcgcggtgcggctgaacgccaccttccgcagcctcggggtgctgttcgggccggcggtcggctcggcgctgctgctggggctcggcccgacctgggggatcttcgccaacatcgcgttctacctgccgctcaccctgttcctgttccgcacccggttcaccgggcacagccgggacggcggggtgccggccggccggaaacgggtcgggatcatggactcggtgcgggtgctgcgtcacgtgcgggccgaccgcaccctggtcagcatgatcatcctgggcgggctgggttcgttcttcgtcggcgcgtccctgcagtccgcgatgccgctgttcgcgcaggacctgggcagcggcagcgccggcacggcgtacggcgtcctgctcttcgccaacggcgccggcggcgtgctgggcggcctcgtgctggagacgaccggatggatccggcccaccgtgttcgccgcggttctcagcaccggcctgtacgggctgttcaccttctgcttcgcgatcaccccgaactacccgctggcggtcgtcctgctcgtggccggcggggtggcgaacctggcgtcgatgtcggtcgggcagaccgtcgtgcagctgatggcgccgcccgccgaccgcggccgggtgatcggcgtgtacggcatgtccgccaacggcctgcggttcggcagcggcatcacggtcgggctgttcggcgcggtggtcggcatccactggtcgctggggctcagtgcggcgaccctgtgcgtgggcacgctgatcgcggctagttacgcgcggcgaacgtgacgtcggccagttcgttctgccccttcaggttcgggtggaaatagtcgaacctgttcaccaggtccaggctgaaccgcagaccgtgcacccggccgccgtcccatcggcagcggctgccgtacccggcgcacgagcggtgcagcacctcgtcgtacgcgtcgatccgatcccgcaccgcccggcgccgccgctcgtcggcggacgccgtcgaggtcggatcggccagcatcgacgggcagacgcccccggtccgccagacccggaccgcgtcgtcgtcgttgcggccgacctgccacagccggtacagatccgggatgctgaccatcagcagatccgccctcggcagacccttcttcagctcggccagcccccggtccacctcgttgcggaacgtggcgaccggtgtcatgtccgccaccgacccggcgcaggcgtcgttcgccccgatcaggatcgtgacgtactgcgccttcgcgtcgaccgcccgccgcgcctgcgtgaccagcgcatccgcctcggcgcccggctcggcgaaattgtgctcgttgcccttgatccccggattcttcgccaggatccgccggtagtggctgtccacaccgtcgttgtccccggtcgaccaggaattgtgcgaacaggccaggtaggtgacacagctgccgaccccggcggtgatcgagtcaccgagcgcggccatcgacgccgggccgccgccgggccggggcttcctggtggcggtgggcttcggcgcgggatcggagccggcacccccctcacaggcaagcgccaaaaccccgagcactgccagaacaaccagatgccagcggcgctgcacgtgtcccccgttcaccgacggctacaactccggcacgatatgccaccgaagctttgtccgtcatgttcccaacctcacagacaaactctgtcgccacactgcctagatcaaagatgtcgcacctcggttgcatgatggtgccgaccaactaggcaattgcctagactcgcctcgcattcagcacgggggatcagtggatctcgatgagatgaccaccgagcttggccggctcaaaccgcgacgaccgtcagcgcatcttgcgattactctcatttgggccgcccagcgcgccgaccgggatgagcctaggcagagtcggtggtctgacgctcggtcgactctccaagacgccgtcgccaaggtgagcggccacgccgcggctgatcaggccgcgtccccagtcgttgccttgcggggctcgccactgtggtccatggatgtcgatgccggcgctccgcccctggccaaccgcgatgctgccggctggctcgaccgagctgatccgctagtcgggctatctccggcggcttactcaacgctgcgtggtggcggctttgaggagttcgcgctcgccgcggtgggcaagcttgacaccggcacggcccattccgtgctcagctatttcaacgtcgaacgactgccgttccagggattcggcgacgtccccggcattgatgtgggcgccaccttcaaggaccgcgccgacctcttcgcccatcgggtgcaccgggagctccaagccggtatcgccggttccgccagcagaggcgcggagtccatcgtcctctccggtggatacaccgaccgcgacttcggcgacgtcatcatttacaccggtcatggcggccgggacccgagaaccaaaaggcagattgccgaccaagatccgaaggcccgagggaatgccgcgctgatcgtcagtcacctcaccaacgctcccgtgcgggtcattcgtggtgctcaccgcggcagcccacacgcgccggccgtcggtctccggtatgacggcctcttcctggtcgaaagcttttggcaagagccggacgacaacggattccgcctctgccgataccggctggttggctttcgcccctccgccgtcgtcgcgacggctgaaacccacaccacaccgtcgacgcccctgccgtccggatcgacgaatcccggtcgcagggcgacgacatcggaacggatcatccgcaatgtagcgctcgccaacgccaccaaagcactgcacaaccacacctgccaggtgtgcgatacccgcctgctgattcagggccgggggtatgcggagggtgcgcacatccgaccgctgggcgaaccccataacggcaacgacacgcccgacaacatgctgtgcctttgccctaactgccacgtcctattcgacaacggagccatcaccatcgacgccgacctgaccatccggtcggaccagccacaccgcgggatattacgccgcgctgagggacacgacatcaaccccgcgttcttggcctaccaccgggagatctaccccggcaactagaccagtccccacccaccggggacggcaagcccgccggattctccacgacatcgcataccaccgatccgctgcggatgccttcgtacatgcgagatggtggaaatctggagacgggctgatcgtgtggaaggacggcacgatcgcacggcggacaaccctgccggctaccgacgccgagatcgtcgacatgacccgggacggcaccggcgtcgccaccggctatctgcagaaccatcaggcttccttcgggtacgccgacggccgcttcacccggttgcgcggcagcggcgtgggagcgatcgcgatcaacgaggccggggtgatcgtcggagggaggggcgggtctcccgggggagtgccggttcgctgggcgtcggcgtccgcggcgccggtccggctgccactgccggccggggcgaccgagggctcggcgagcaacatcgccgaggacggcaccatcctcggctcggtcggcagggccgggaagtcggccaccgcgtatctctggtttcccggcggcaccggccgctacctgccactgtccaccgtcgacggcggccgcagggcgacctccttcgcgccctcagcgatcagcaacggctgggtgaccggcaacgcggtcgtcgagaccgagcagtcgacggcctccaccccgatgcggtaccggatcaccaccggtgagttccaaaggctgccggccgatctctggagcgccgagaagatcgccgcggacggctgggtggccgccgagggactggacctgtcggtaacgggggatgccggccggcgctcatcggcgccggccggcgtcggcggtgatcgcccggatctcggccaggccggtggcgccggcggtggccgccgtgacggtaagccgcacgctgcgcaccctcttcgccgggaaccgcacggtcagcggggcgccgccggccggtagcgggccgaaacggatccggctgccgtcgtcgaagcgcagcacgccgccggcgatccggccggccgggtcgcggcggccgaacagcacgatccggtccagccactgcggctgcggccaggccaggccgagccacgcgccggcccgctgaccggcggtgacccattcaccgatgagttcgggtccgagccggccgtcgaccacccggaccggggtgcgcccggtgccggtgtccccggacgagccggtgacccgggcttcggccgccacgttgcggcccgccccgtacggcagctcgaccgggacgttgcgccgcaggtagccgccgtagttgccgcgcatgcaccagtcctcggtctggcagaccaccgggtcgtgcggcgcgtaggtgaggaagtagccgagcttgaccgcggcccgcgcggcgtccagcgtcacggggcgctgggagaccggatatccgaggtgcccgacggtccggtgcggtgtccggtaggcccgctgcgccgcccaggtcaggtaggcggtcgtgtgatggtcgtcgtggtcgccgtcgccgtacgcgtcacggaagtccagggtccggatcaccgccggctggtacgtgtcgaggagcgcgagcagcgcgccgaccagcgccggtcggtcgtatgcctggccggtgtccagagtgcgcactcgggtcgccgggtcgagccacagcagttgcagggtctgcgccggccagccgccgagccggtcgggcaggcgcaggaacagcagggtgatcgcggtgccggccagggtcgcccggtgcacggcgtgcccgtcgacggtcagcgtgtcctcggtccactgcccggggcggccggccatccgggcgtacgccgccatctccccctcctcgcgcccccgccagtaggccgggccgcgggccgcgtcacccgaggtgacgtagacggtggtgacgcagcgcccggccgcgatgtcgtcgctgatctccgggttgaggaagagcaggtcgtcgtcctcgtgcgcgacgacgctcaacgcgttgcggcacgggccgggcgcggccaccgcgaccggcgccgccggtgtcccggcgagggtcagcagcacggtagagagaatccggatccaacgcacgctggacgttctatcaggacattcccgacacaccaggcttccgcgcccgtgtctgcaagatgaaccattccatgaaggaagttacgtttcgtctgcaagcaattgcagaaagccgtcagactcctagcctgagccgtgaccgctccggcctcggcggccaccaccccgcagcagctcggcggcctcgacatcggcgcctactgccgttcgatcggctacaccgcgccggcgggtagcgggcggggtgtttcgctttagaggcgagggggacggccgaaggtgcgggtgctcggacagaccgcacgcgagggggcttaaatgaccgatctttcggagtacaccggccggatggccgcgatcgaccggtcgcaggcggtgatcgagttcggggtggacggcaacgtcctgaccgcgaacgcgaacttcctggccgccaccggctacacactcgccgagatcaccggacggcatcaccggatcttctgcgatccgcagtacgccgggtcggacgcgtacgcggccttctggcagcggctcgctgcgggcgagttcgaggccggcgagtaccggaggttcggccgggacgggcgggagttgtggctgcaggccacctacaacccgattctggacgagcagggccgggcgtacaaggtggtcaagttcgccatcgacgtcaccgcggccaagctgcgcaacaccgagttcgccgcgaaggtggacgcgctgaaccggtcgaacgcggtgatcgagttcgacctggacgggacggtgctgcaggcgaacgagaacttcctgcggaccatggggtacacgctgcgggagatcgtcgggagtcaccacagccggttctgcaccgaggactaccggcgttccgacgagtaccgggacttctggctgcggctgggcaagggcgagttcatcagcgggcgcttcgagcgggtcggcaactacgggcgccaggtctggatccgggcgacgtacaacccgatcatggacgtggacggcaagccgatccgggtggtcaagtacgcgtccgacatcaccgcccaggtggagcgggaacagcggatcgacgcgctgatcgccgggacggccgaggtgaccacgtcggtgcagagtctgtccgagtcgatcgcggagatcgccggcacctcgcagaccgcggccgagctggcggcgcggacacagaccgcggcgaccggtggcgcgcaggcgctgcaggcgtcgatggaggcgatcggcctgatcgagaagtcgtcgaaggcgatcgccgacgaggtgcgggtgatgagcgagatcgccaaccagacgaacctgctggcgttcaacgcctcgatcgaggcggcccgggccggcgaacacggcatcggcttcgcggtggtcgccgacgaggtgcgcaagctggccgagcggtccttcgaggcggcccagcacgtcgggcggctggtcgaggaggcggcggaacgggtgcacgagggttcccgggtgtcggccgaggcgggcgcggcgttccagcacatcgtggacagcgtggagcggacccacgaggcgatcggcagcatctccggctcgacccgggtgcagcaggccgccgcgcaggaggtcgaccgtctcgtctcccggctggtcgccgaacatgcccgctgaccggatcacctacggcgccgcccggctcggcccgctcaccctggcgttgccgctgaccgccctgcacgaggcggtcgcctgcccgccggcgctggatccggcgccgttcccgggcggcggcgtggccggttcgctgaacctgcgcggcctggtgctgccggtactcgatctgcgcccgcacctcggggtcggcgatgccgccccggacgagcaggtggtcctggtcgtcgccgacggcgagcaccggttcgggctgctggccgacggtgtgctgggcatgctgcgccccgagccgggtgcggtgcggccggtgacgaccggcgccgggccgtccctggtgtcgcacctgttcaccgaacccgccggggcggggccggtcgcggtgctggacaccgcggcggtgcgccgacttccggggctgcccgcggtgcaggtgcgggacacgcagaccgcggccaccgccggtggggcgacacggaccgtcgtcgtggtccgctgcggcgagctgaccctgggtgtggacacctccctggtgcacacgatcacgccgggtacggcggccggcagattcctgtcgtacgacggccgtaagctgcccgtgctcgacccgctcccgctgttcggcacggaccgccccggcccggccaccgtgaccgcgcacctggtgctgcgggtcgccggcggccacgtcgccctgccggtcaccgcgctcgtcgggctgcaccggctggccgaggccgacgtgctcgccgtgcccgccgtcgtcctcccccgccccggcctgatcgccggcctggtcgagactccggcggccggccggttcctggtgctcgatccggccgccgtcgacgccgatccggatctgggcgcactggcggcggccagccggctgggcgcccgcccggagtcccgggcggtggccgcgcgggccggcgggtcattcctgacctacgccgccggcggcgacttcgccaccccgctcgaccagatcaccgagatcatcccgatgcccgccggagtcggcggcgacggcccggtgctcggcatgatccagcaccggcgggccgccatcccgctggtctgcctggccggtctgctgggccggcggccggagccggtcaacccgtgcgtgctcgtcgcccaggtcgacggtgtcccggtcggcttccggatcgaccggctcggctcgatcgacacggcggagtgggcgggccgggccggcggtgcgggccgggtgatccgggcggtggccgccgcccggatgatcagcgagctggatctccacgagaccggccgccgggtcttgtgtggacggccctgagcgaccagggtggtgatgcatacgcatcgactctgacgagtccccgggggacctgatggcgtaccgtcaattgcccgccctgaccgcgaccgtgaccctgactctgaccttgaccagcgccttcgtgccgtcggcggcgcaggccgcgccccgcggcccgaacgccgtggtgacctggaacctcaacgcgcagaacgagatctacgaggtggcgaagcagtcgccggccaccgcggcgcgcagcttcgcgatggtgcagggcgccgtctacgacgccgtgaacgcggtgtccggcgtgcccttcgagccgtacctgaccgcgccgcgcgcgcaccgcggctatgcggtcgacgccgccgtggccgcggccgcctccggggtgctcacctcgctcttcccggatcaggccgacactgttcaggcgcagtacgacgcggcactggccgcgatcccggacggctgggccgagaacggcggcgtccgggtcggccggcaggccgccgacgcgatgatcaaggcgcgggccggggacggcgccttcgacacctcggacagttaccacgtcggcaccgcgcccggccagtggcggccgaccccgccgaccaacgtccaggacggcgcctggttcgccgacctgaagccgttcgtgctgccggacgccgcgatgttccgcaccgccggtccgcccgcgctgaccggggccacctatgccaaggacctgaacgaggtcaaggcgatcggcggggtgaccagcacggtccgcaccgccgaccagacgcggtcggcgatctggtggcacgaccgccggctcaccgagtgggacatgaaacgccagctcgcgatcacccggcacctgagcccgttgcagaccgcgcggatgttcgcgatggtcgacatcaccaacgtggacgcgctgatcgcctgctacaacgagaagaagtactggaacttctggcgcccgatcaccgcggtccgcgaggcggacaacgacggcaacccggacaccaccggcgatccgagttggacgccgctgctggtcaccccgccgttcccggactacacctccgggcacacctgctcgttctccgcgatcaccctgacctggcagcgcttcttcggccgcgacgacctgccgatcagcgcgtacagcgcggactccggcaccacccgcgccttcccgagcttctcgtcggcgctggccgaggtgatcgaggcgcggatctggggcggcgtgcacttccgcagcgccgacgaacagggggtgcggatcggcacgagcaccgcgcgctacgtgctggcccgcgagttccgaccgcgccgctgaaccggcgcgcgcgggtgcgggtggacgcggtgacccgcgccgtgatcgggtcgatccggcacgggcaccgcactgacccgccgcggcggcgtcggcagcgtcacgccggcaccagacaggtgagcaggtcgttcgcgatgtccgccgccgccccccgcaacgccttccggctcccggcgtcgttccgcttcgcgagcagctggatgcggacggtggcattgccggaccgtacggcgattcgcgtctcgtcgaagccgacgtcctccgacatgaacgcctgctcacctaccccgttgagcggctgcttcagcgtgctgtcgccgatcgcccaaaccctgtcggccgctgcctgctgagtggtcgtggtcaggttcatgatcgccgacggggcagtaccgtcggctggtccccactggcagctgatggtgtcgccgagggcgctgaggtgatcggcgtcgaccacctttcccactccggcgattccggccgcgacggccgccggcctggtcactgagggacaggcgagaccatcggttttccagtgatgagtggccggaggcaccgatcgtcgcgaatccaccgacgggaacagcgacggcggtagggtcacaccgggtgacgacagcggactgttgatgtccgggacgtcgaccctggaacaccccgcgaggatcgacacggtcaacatcgcgatcacgccgagcaggggtcgcattttcacaggtccaccgccttcggccagttgcctcccggaaacgcgctgttgtcgctgtgctcggccgcgacctcggtgaccagacggatcacctcggtgaatcgattggccaggctggtgagaaagtcgatgatggcggcggcgtacttccccatcatctcgtccagattgttgacggcctcctgagcactgagcgggtcctccgctccgatggcagtgccgatgtccaaggtcaccgtgaccaactcctccacgatggttgtggcctgatccaccagttcggtgacgaagtgtgtgttcgcttccgccacgtcggcaagccacacgctgaggcttttcacctgcgcggacgcaagcccgacagcctctccctgctcggtctcccgagtccggtaggtgtcgtgcgccgggccgtgccacacgtcgatgctgccggactgctcgacgtccggctggatcgcgctgagtcgtgtattgatcgtggtggaccagtcgatgccggaccggaacagcgaaagaatcggtggtgtgccgctgagcgctgcatccatcctgccgaggatgtcatcgagtttcacccgagccgactcgattccggcctcgatcgcctcgagcgtgtcggcgatgtcgtcggtgaaccattccgcgatcctgttccaccagtgatcgtcctggagtttcgcgcgaatcgccgcgagaaactcctcggccgtgcgagtgaactcgtcccaggcggtgcgaatgccactgacctgtttctccagcaggtcgaccgcgtcctggaaggtgccgaggagcgccggggcgaacgatccatccggttcagtcatgtcaggcctccttccgtcagtgcggccagtcgccggcggcgatgccgtcgaagctctgcgccgagtcggcatccgcatcctcgtaccagtcggcgtttcgtttcagagccgcgcccatcgcatcgaactgctcgaccgccgccgcgaacagccggttcaggcggtcgaactgctgctggtaggcgtcctgcagatcgctggtggcagcggagccgaccggaccgtcgatgacgacggagaaggccgactggtcaaggtgctggcgagcagcggtcgaggagaccgaagccatccgatccgcgagtccgtgccacttccggcccgattcccggagaccttcggtggcgactcgaacgttctgggtggaataccagttgtagtcgtttcccattacctctccccaggtgtgatgccgagtcgcgaggtgagcagcgcgtcctgggcgtcggcggcgagcacggcgccatcggcgcgacgcaaaccgtggacagcgacccgggcgccttggatgacggcacctcgcatcaccacggtgaacaggcggcgcggtccggtgacctcccgggacgtgcgtccgctgagcagttccgacaaccgggcggcccggtcgaggccgatcgacgcctgttcgaggcgtcgccggagttcggccagatcctggtggtccgcgtgcccgctcggataggagcatcgccggccaggatccaccggcggggacttcgctcgcccggcgcgtccgtggtggcgcaggaccagccgagcgaagccggccttctcgcacgcgaagcggtacgcctccagaaccgcgtccgcgatgcggtcgggaccgacggaatgccaccagccgtcgacgatcgccacccgaagatcgccgcggagcccgacccggcagtggaccgtgccggtcgggtcggtgccctcgatcgcggccaggcccgggacgggccggccgtgcggggtgcgggccagcgcgtcctccaggttctgaacgaacctgcgggcgtcacgcagccggtagtcgtcggactggctcatggttgccgccacctcacgggcgagggattcgggcgtcgcacaacgcgcatcgatgtgcgcatcagggagtacgccgccgtcggcgaccaggttcaggccgtgtccccggagaacctggacaagaaagtttagaaatcgaagaccttgactacatgccacgatcgttgttcaactgtgtttgctcacgattgaacacgagcgttcctggaccgttctcaaggagcatcgcgcgtgaagaaacagatcctcaccctggcggccgcggccgtcgcccttctgacagtgaccgcgacgacggcgacacccgccgcggtggccgccggcgaacccacctggcatgccggcatcccgccgctggccactccgtggaccggccaggtcggcccggacaacgccctgcccgactacccccgcccgcagctgacccgggcccggtggcagagcctgaacggcgtctggcagttcgccggcgcgaccgtggggcaggccgtgccgaccgggcagaatctcggcgagcgcgtgctggtgccctacccgatcgagtcggcgctctccgggatccagcggcacgaggaccggatgtggtatcgacggacgttcaccgtcccggacggctgggacgtgggcggcgggaatcggctgaagctgaatttcggcgcggtcgactacgacgccaaggtcttcgtcaacggcaggcaggtcgccacgcaccggggcggctacgacaagttcgacgtggacgtcaccgacgcgctgaccgggtccggtgagcaggagctgatcgtctgggccgaggatctcaccgacgccaccgggcagccgatcggcaagcagcgccgcaccggcgatcacggcatcttctaccagggcagttccggcatctggcagacggtgtggatggagccggtgcccaccgacagcatcaccgggctgcgcttcacgcccgaccccgaggccggcgtgctgcgtctcaccgtggacgtcgcgggacgccagaatctacaggtcaaggccgtggcgcgaggcagcggcgcggtggccggaaagatccagggcggttccggtacggagttggccctcccggtcaccgcggcgcacctgtggtcgcccgacgacccgtacctctatgacctggatgtctccctgatcgacggcaggacgaccgtggaccgggtcggctcctacgtcgggatgcgggcggtcggcaccgcgaagggtgcggacgggcggctgcggatcacgctgaacaaccggatcctgttcaccatggccaacctcgaccagggtttctggccggacggcctgtacaccgccccgaccgacgcggcgctgaagtgggatctcaagaaggacaaggagatgggcttcaacgcggtccgcaagcacatcaaagtggagccggatcgctggtactactgggcggacaagctgggcctgatggtgtggcaggacatgccggccgcgaacaccgggccgatcccgccggagtggcgcgggcagttcgaggccgagctgcacgagatggtccgcgagcatcagagctggacgtcgatcgtcgcctggatcccgttcaacgagggctggggcgagtgggaccgggcggccaccggccggatcgccgacgacgtcaaggcccaggacccgtcccggctggtgaacgcgcacagcggggtgaactgctgcaactcgcacggcgactccggccgcggcgacgtgatcgactaccaccagtacctgggtccggcctcgccgcggccgaccgcggaccgggtggcgatcgacggcgagcacggcggtttcgggctgaaggtgtccaaccacatgtggttcggcgacggcaacgcctaccagatgaccccggacaaggccacgctgaccgcccgctacgtgcagaaccagcaggacgtgctgacctcggcgcagcggtgcgggatcagcgcggcgatctacacccagctctccgatgtggagggggagctcaacggcttcttcacctacgaccgccgggtcaccaagatggatctcgcccaggtcaaggcgatcaaccagaagatcatcgcgggagcggacggcaccacggccggcatcccgcagccggatccgggcaccccggggctgtccgggatcgcgttctggccgctcgacgggtcgtacggcgatctgacgccggtcaacgctccggccttcgccgacggccacaccggccagggcgtcgcgttcaacggcggcaaacagtacctggacgccggccgcccggtgctgaacaccgcctcggactactcggtcgccgcctgggtcaggctcgacaaggcggacggcgcgttccagaccgtgatcagccaggacggccccgccaacagcgacttcttcctgcagtactccggcgccgaccaacgcttcgcgatgagtttcgccggggtgcgcgcgctggctcccatcagacccgaggccggccgctggtaccacctgaccggcgtgcgggacacggtcaaaggccaattgcggttgtacgtcgacggcgagctcgccgggacggccgacgcgtgcctgccgcagggggccccgaccggcaacaccgtgatcggccgcggcaagttcggcggcaacccggtcgactacctggacggcacggccgaccaggtgcacctgtacgaccgggcgctgtccgccgacgagatcaggcagttgtacgcctccggccggtaacgccgggaccggtgaccgctcgccgggttcgcgcccggcgggcggtcacaccgcgccggccgccggcgtcccggtgccgctcccgttctcctcgggcagccgggacagcagggcccgggtgttgttccgggtctcgaccaggatcagcccggccgtggtggcggcgtctccgcggccgaacgtgtcgtcccaggccgacaccgcctggtccagctgcggtttgagcttcaggtagaccgcgttggcgatcttctcgatgtcatcgggcgtcacgacgtcctccagcggccatggtgcggtcgagttgttgccggcgtggtcgtgccgcgcgctgaagtgcgcgtggccggtgtgcggatcggcgctgccggcgtaggcccgccaggtccagccccgggcccgcgaggcgatccgccggttccagatgatgtattccagccgggagtcgccgcgcagcgtctcgaccaggtcaccgaacggctgtggccacggtccggtcgagtcgatgtcgagcgcgaggacccggccggcgcggtccgggttgtggtcggagacccgcgagctgtgcgcggcgtcgccgatccagccgtcgctgtccttgtcgcgtctcggcgacagccggttgaactcagaccgcaacgtcaccagacaggggacgagatacggggtcgtcatcggtggggtgcccttccgctggctccgccgcgattctgcccggaccggcagccggaaaaccatcgcgctccccgtacggatgacctccatggcgtcgcccgaccgcaccggacggcctcctggcatgcccactgagctgcgcgaacgacgcgcggcggggcactgcccggtgcggatgtgccaactcgtaccaccaatcgggtgttgatgtgaagatcgtgaatgcgttgtttcacggttccggacctttaaggttaatttatggttaccccgaaaaccggctctgaactgcgaaaacgccgggtccgtcgcgctgcgtgcaggttgacgacacatcgacgggagcgtttattgttagccaccttttcaatcccggcccgacccccatcccggcaagggagatccccgccatgcccctgaaacgcacccctctgctcgccgtcggcaccgccgcgctcgtcgccggcaccctcggcgtactcggcatcaccgatgcttcggcggccagcgccggcacgctggcgagcgcactgaacggcaaatgtctggacgtgaccgacggctccaccgccaacggcaccctgccccagctctgggactgcgtcgccggcagcgccaaccagctctggaccctcgccgacaacggctcggtgcagggcaggggcaagtgcctcgacgtcgcgaacaacgccaccaccgacggcgccgcggtccacctgtgggactgcttcgactcggtgaccagccagaagtggacactgaacgcggccggcgacctggtcaacaaggcgtccggcaagtgcctggacgtcagggacaggaacaccgcgaacggcgccaagctgcagctctggacgtgcaccggcacgtcgaaccagaaatggaccttcggtggcggcagcgttcccaccaccccgccggcgaccggcgggccgggagcgaaagccgtcgcgccgtactactacaccggctggggcaacccgccgagcctgagcgcggtcaccgcggccaccggcgtcaggtggttcaccatggcgttcatgctgaacagcggcacctgcgacccgaagtgggacggctcccgcccgctcaccggcggccaggaccagaccgcgatcaccacgatccgcgccgacgggggcgatgtgatcgtgtcgttcggcggcgccagcggaccgtggctggagcactactgcggcagcgcgtcggcgctggccgcggcctaccagaaggtgatcgacgcgtacggcctgaaagcgatcgacatcgacatcgagggcaccccgtacgacagcgccaccgaccagcagaagacggtcgacgccctgaagacgatcaaggccaacaacccgggcatcaccacctacatcacgctgggcagcggcaccggcggcccggacgactcgctgatcaagcgcgccgccgcggccggcctggtcgtcgacggctggggcatcatgaccttcgactggggcaacaccggcggcaaccagggccagctgaccatccaggcggccgacgggctgaagaacaagctgaagagtgcgtacgggtggtcggacgccgaggcgtaccaccatgtcggcatctcgtcgatgaacggcatcaccgacgagcacgccacggtgaccctggccgacatgcagacgatcacggcgtacgcccagcagcacaccatcgcccgcctgacgttctggtccctgaaccgggaccgccagtgccccggcgcctaccccaacgacgacacgtgcagcggcgtcgcgcagtccgcctaccagttcaccaagatcatcggcgcctaccgcggctagaggctggaccagcagtagagggactcgccgtgcgcccgggcccgcgcggcgagctcccccagctcgatgatcacttcggccaggtactccgtgtcgacgtcaccgaagaactcctcgatgccggcccaccgctcggccagttccggcgcccggccggcctcgatgccggccagcgcgtcccgcgccggatcaccgatgcccgtcacccagggcccttgatactcgaggtcgcggtcggcgctcatcggccagatgagacgttcgctgaccaggtcggcgctccactcccggtccgccgccatcgcgatcatctgcgccaggatcacgccggggtcgatggtcttcagcatcaccccgtcgaagaactccgggaccggcgagtaaccctcgttctcgtcgagcttccgccgcacctcctccacctcgggcgcccggaaatagtcgaacagaacacccatcgtttctccccctcggcggccggcggccggcatcgggccgccgggacagattgaagccgccatcggatccgcctgacaaccctgtgcagcatcgtcaccttctctcgatgcaggacgcctcccgtacggaggcatgcggcatgatggctcgggtcgatcggagagacgtcatgagttacgagcacctgccacccgctgaggggaatctggagaccttcggcctggccactcgccgggtgatccggttcagcgtgggttacctgctggtctcggccctgacgacggtgctggtcctggccggggtggcggccctgcgcagcggcgccgccgacccgctctccgtgggcacccaggcgaccttcgcgatcaccaacctgatcctcggctcggcgacgctgatctgcctcatcggcctgctgatctccacgatcgtctgggcggtgagcgccgaccgggtggcacccggcggtcccggcgcccccggttacggcggcctgaccctcgccgtcctgctgatcgcgctgagcgaactgctgaccgcgccggccctgctgctgggtgctctccagctggccgcctgggccgcgctgctcgccggcgtgctgatcacccgcacccggctccgccgccacaccggcgacgtcagcctgggcggccgtcgcaaaccggtcgtgaccagcgacgactgggacgcctcccggtgggacccggaggtcgcgcacgacatcgagcggcgcggccgccccaccggctgatcactcctggcgtcgccgggcagactcacgaatcggcgccagctccgaatccggcagacccgcgcggcgagcgtcgtcgatgaccgcgtccagctgacggtcgatctcgacgagcgtcgcggcacggtcctcgcgggcggcgacgacgtctcgcagcatgcgcagcacccggatcagggtcaaggccacctggggatgaccaccggcgaagaggcggatctggccgtacgcgtgccgaacgtactcggcatggtccaggtcccacggcgtcagcaggctccggccccggtcgtcccggtgcgcctgggccggcaggtcagcctgcaggagcggacgcatgacggacgacacccgcaggatcgactcgaccgcggtggtcgggtcgttgaccgccggcgacaacgcgcgcaatccgatgtcgttgagctggcgcagcgcgaagtcgatgtcctgctgcatggtccgggtggcgccgatgacgaccgcttcggcgatgagctgggcgatccggtgcgcttgcgccttcgccgggcgtggccagatccgcaccagcggctcgtcgcggatcaggtacgcgccgacccgggtctccaggcggaccgtgctgcccggcggcaccgcggccaggatcgccgggtggctgatctgctgcacccagccgtcagccggggacctgaccgccagggcgtcgccgggttcaccggcccgcggggcggcgatcggcgcaccgacctggatgcccatccgggacccgtacggcagatcatcgatcagttcgatggcctcgtgctggattcgttccatgatccggcccacgtactgctgccgggtgatccggttgaggaagacgacgatggccagcaccgaggccagggagagcccgaccgccagggtcatggtcagtcgcggcgcctggtcctggctgtcgatgtgccccagcgcgagcacacagaaggcgaacgtcgccagcagcagaccgatcagcacctgaccgatccgatcccgccagaaggtgcgcagcacccgcggcgagaactgaccactggccagctgcagcgacaccacgagcagggagaacaccactccggcggtggtgatggtggcgcccgcgatggtggacagcagagtgaccgccgcgtccgagctcatggcgaacagccccagccccgccggctcccggctccggtcgatctcccgcgccgcggtctcggcgaggatgccggcggccagcagcagcatcggcaggaagagcagactctcccgcagccggtcgccgatcgcgcgctgcctgagccgccgcaccgacggagcgatactcgcgtgcgtgtcgtcctccacgccccggaccctatccgccgggccgccgggcggcaggactcatcccggcagcttatcgacagccatgcgctcggatgacgaccggcacgccaccgctctgtctagcggtagtcgcacgccgggttcggacccgacgtcacctcgatgatgtcctcgagccggtcccgggcgagggtcagctcggcgatctgcgcgttgatccggtcccgctccgccaccaggcgcgcccgcgactcgggcgtgctcaccttggcgtcgacacacggcagcaactccgcgatcgtcctgctggacaggcccgcaccgtacaactgctgaatcaggcgtacgcggttgaccgccgcgtccgcatagaggcgctgcccgctgccgctgcgcgtcgaggccagcagtccctgctcctcgtaatacctcagggcccgcacactcacgcgcgtccgttctgccaggtcgccgatccgcaccgtgatccacctcgcaacccttgcctctgacgtcaacgtgaggttttagcgtagcggtatgcagatcaacggcacaaaagccctggtgaccggcgccaaccgcggactcggcaaggcgttcgccgaggccctcctcgcccgcggcgcgaccaccgtctacgccaccgcgcgccgcccggacagcatcgacatccccggcgtcgtcccactccaactggacgtcaccgacccggcgtccatcgccgccgcggcggccggagtcggcgacctcgacattctgatcaacaacgccggcatctccaccgacgcgccgctgctcggcccttccacggacaacatccgccgtgagttcgacaccaacttctggggcaccctcaacgtcacccgagccttcgccccccggttggccggcggcgcgatcctcaccgtcatctcggcgctgagctggtacgcgttcgccccgtccagcaacggctacgcggcctcgaaggcggcggagtggtcgctcaccaacggcatccggctggagctggccggccagaagacccaggtgaccgcgctggccctggcgatcgccgacaccgacatgatggccgggtacgacatcccgaagctcccgccgcacgaggtgatcgccaaggcgctggacggcctggaggcgggcgcgctcgaggtcatcgccgacactccgaccgccaacgtcaaggcgtccctgtcccgcgatcccgccctgttctacgccgacatccccggcgccctcttcggctgacagaacggcgcgcgccgcggtggagggcggggcggccgggcacaccatcgcgtggtcgttgcaggtcgccggcccggcgacaggtaccggcgtggccggtcagaacaccggaaggccgttggtgtcgtccacgagacgggcgcccagcggcttgtggagccgcaccggcaccaggtaatacgtcgcgccggagtaggcgaactctcctcggcagtccgactggcatgcgtccaggacggcgacggcgacccgatcgggggccacctcactgatctgaacaccgatgcggtgccggacgtcctggtcggccgggcgggtgccgcgtcgcccgcggtggtttgatcgacgcacacccatgccagtacgccgatcatgacgatgttggcgagccggttcaggtcgtacacgacgtcgttcggctcgctcccctccgagttgcgacagcgccaggcgtagatcacctgccactggaatcgaggcgagatcacccccacagcagcaccgcggcgagcgggatcgccatcaggagaagcccgtccatggccgacgacggtatcgacaaccgccaaaccgaacggccccgagccgggcggccgagcttcatcacggtggccaaggacggtatcgtcagcgccatcggattcacgacgatcatcatcggccaacccgccgcaccgttcatcgccgtcggagcagcgctcgccgcctgtacatcgaagtcgccggcgcggaaatcctcgaaggggtctgttcgtcgatgaacgccagcctgcggcaaaaggtcgacgacaccgccttctacggcggccggtggccgcgggcggtcacacggtgaccggcgccccgctcagtcgcgggcaatcggttgccatggcgataacgctgggaatccacgcgctggccgacgtcgctctggtgtggctgggatcgctggtgtggaacgcgtaccggcagggcaccctcgccgccaccgaagcggcatccgtctccatcctcgcggtcagcgccggcgtcggagccgtcatcaccgtcgtcttgcagatcgggctgctgcggggaaccaacggccgccacctcgtgcaggccgccatggccctcaacctggcaaggctgctgggcctgctgctcgctctcatgatcaccgcggcacggctcggcatcaccgcccttgccggaatgatggagacgttcgccgccgtgatcgcggtggcagaggccctcggcgcgctctacgtgacgaccgtagtgagccgccgtaccagtgatgggtgaacggattgccgtcgcggcaggcctgctctgcctggtgatgatcgccctcgtcaccgtggtgacggtggcccagcggcgcggcgcccgccgagagccatgactcggtcggcgtctgcccagtaagcagctcgcccgcttgatgcccgccgagcaagccgatggcgggtagacacgcgctcattcctcctgctgggacgccggctggaagggcatgccgacccgacacataggtcgatctgaaccgtctctgaccgccctctggcctgcgtcgatcacgggaaagggtagatcgatcagtgcgcttagggttgcgcctggtccgggccctgcgggggatacgggccctgcggcgggtacgggccctgcgggggatacgggccctgcggtgggtacggagcctgcggtgggtacggagcctgcggcgtgcggctccgagacgcgcgacgtaccaacgcaatgactgaccacaccagggcgcctaccacgataagacagcagaataggcggaaccctacgaagccaagcgtgtaagccaggccgtgcttctccaccacttgccgtcccctcccgtggatcatgcgatgcggcgtcgaccctacacccgccagaccatgcgcgaacgcccccttcgacgggcaccaacacggcgcgtaccagtgctttcgacgcggatgccgcgcggccctcattccgcctgatgccacgatggacgccgaagtaaaggccgcctcggcgttacggtgttggaccgagcacagtcctccgggatggacgaggcaggtcggtgacgacggccggcccacggtgcgcttcggcgccggggtagccgtgggcttgcagcacgccgagggcgcgtcgaaatcagcggcgcccggaacacctcgcgatcggtgaaggagggcacgtcgggatggtgtgggcgttgcgggtggccacgtccccccatgtcgtcgaacgcggcgaggcgtctgcggcgtagtactcgccgatcgcgacagctcgccgcgcagttccgacctcgactgactcgccccaaccgactccgactcgtccgcgagtacggggtttcacgctcgacggcgctccgggcatcgcccaccgagcaagagagggacctcaaccgcgcacctggctcgacgttggcaatgcacagagctcgccgctcgcgtaccgccgcaatcgccaccgcacccaaggcggaccgcaaccgatccgcccaccgcgcccaccgtaacgtggggtctgggagtcgccccaggcagacaaacctgggccggacgttgcaccatgcgaaccaccccatcgccatccccggtggctcactaccgggacgtctgaccagctcacggagcaggtagtcgcactcaggccgccgtcggcggcaccgggcgagcgtcaaaagcggcacaccgccaccaccagagtggtaccatattcggtacaaccttgggaggcgtcgtgacttcagcgatcagtgccagcgaggctcgcaagtccctctttccgctcatcgaacgagtcaacctggaccacactccgatcgaaatcgtctccaagcgcggcaacgccgtcctggtgagcaaggaggactgggactcgatcatggaaaccaactacctgcttcgatcccccgccaacgccaagcgcctcactgagagcgtcgagcaatggcgagcgggacgagccacggagcgcgagttcggccccgaggagtgaaactcagctggaccgaccacgcctgggacgactacctgtaccggcagactcaggaccgcagaaccctcaaacgcatcaacgccctgatcgccgacatcaaacgtgatcccgacggtcagggcatcggcaaaccggagatcctccgaaacaacctcgcgggactccggtcccggcgcatcgacgacgaacaccgcatggtgtacgccgtcgagaccaacgagatcaccatcatctcctgccgataccatcacgaatagccgccgaccccaccatttctgatcagcggcgtctggcgaattctgccaagcgctcgctgagcgggctcacccgcgggcgcggcagccgatggaaatagagcggcttgaactcgcgcatcaacgcctcaccgtcccggacccagtcgaagcgtggtcgtttcagcagccgacggaacacgacactcgccttctccggatgccgagcagccagccgacgcaggaccatcggctccacgctgtcgtcctcgagataggacagcgtccgctcgcgccaccggcgacgtcgcagcacgtcggggttcacgaacgcttcctccacgaggccgaactcggcgtagaagccgagtccgtccgtctcgtcgtaaatcagcgcaaccgtctccgcaccggtcagatccggcggcaacgacatcgacaccatagaggggctgaccttcgggtccggcccgagaaccgagtcacggcagtacgtgtagtagccgtcgagcccgagcaccatctcccgttcgacctccggcaggtccggccgggcctcgacgaactgctccaccaccgtctggccgtccgccagccggtgctccagggtgaaaccgtcccagagcagcatccaccgctgttcatcggcgctttccaagccgttgccgtactcggccagaaaactcgacatagcccggtcgtagcggggctgttgagagaacgccaccagctcgcccttgaggtcaccagcccgtcgtagcagcgcggcatcaaccatcgacatgccaccaacctatgaactgccagagtcagatcatcacggggcgcctcgttcgggtgatcagtcgatcagatatcgagcgaggcgctcggcgttgaggccccgcatcgcgtcctcgacggcttccgagtcggtgaagtcgacaccacgcgccgtcaactccgcggcgatctgcttggccggcccccacgccgccgtgtcgtcgaacgcctcctcgaacgagggaaggaacgtgtcgaccgcctccaccacgggaccgatccactccaggtcgaccgcacggcgttccagggcgtaccggacccagcgccgcaacacgtccggcagcgccgcacgctgctcggcgtccagcgccgccttgcgcggcagccaatcggccagaaacaagccgacctgtcccgggctccagcacaatgggccgctggtcatgtagccgtcgccgtagtccaggaacaggtccgccagcgacctggcgaccgtgtcatcggccggcgcgaacccgtccagcagtcgttgccgttcctcatcgctcatcggctgccagtcacggaaatccggcagatacgaccggcatcgcgaccaggccagcgcccgcaagtcgaggaactcctcgtcatcgtgacggggccaggtcatgtccgtggtccgcaacgcatcggccagctccgccagcgcaacctccaccgggcactcgacggccggcatcggcacctcaccgggctcacgcagccggtcccaggcctccgcagccccgggctgcagcaccgcgagcttgtcgaccagcacaccgccgggtagggagatctgtgccatcaccgtgtgcggcgtctgcccggcgaactcgacgaacagcacgtgctcgctgtcccagacatccaccgcccgccacgcccgaaccggctcgaagccggggatcgcgaaccagtccggcaccggctggctctccgacaagatctccagggtgtcgtccagcatcggccactcgcccggggcggcgacacgacgcagcgccgccaccgcggccagcccgtacagcgacggccgggtcgacgcccgccccaccacctccaggtacaacaccttctccgggtcacgctcaccgagccccgccgccgaccacgccgcaccgagccacccactggcccaccgctcgaccttaagcacactgtcctcagacacgatcgacatagcgtcacgcatcaaccggtccgacaaccgcaactcactaaccgggcgctgcggacgcctcggcttaccccgtcccgcaggacgaccacgactcttgggcatgtacccgtctaccacatccggcccggggcaacatccgagcgacccgcggttcgcgcaatgccacaggaatccagcacttccgggctacctgtcggcagcccggaagaagctctcgactgcgcctgcggcctctacctcaacgacccgaccgcctggctcacacccccgacgaactaacgcggtccagcactagaagtcagcacccaagaaagtctcgtctcagcgtgccaacaagcgcagttgcccccaatcactctccatccgcacgtctacgaagaacgcgcagcgccaagcgcaggtcccgccgtcgcgacgcgccgacatccgccacaacctcaccgcgagccgagcggaggagagcccggtacagccgccgaatcgtgcccggttctgggtcgcggcagcttcgcatccgggacagcgccgatccacagcatgtcacgtgcgcgggtcatgccgacgaagagctgtcgcttcaccagcgccaggcggtcggtctcggtgaggctgctcgtctgcgctttccttacctcgcggtcgtgatgcggcaggaagacgtgcttgaactcgagtcccttggaccggagaaaggttcccaccttcaactcgccggtggcctgcccgtcgtagtcctcgaggttgctgttcgggatgccggcgcgggtcagcaggcgctggtagtggatgacgtccttcttccgggcgcagagcactgccgcgtccccaagccgcgtatcgtcggatgaatctccggccagctccctcacggcggcgaggaaggcttggtcgtgctcgtcagcagtggccgcgtcgacgcggatcactcgaccgtcgtggtaggtggtctccacggcagggccggtggtgacaactgtcccgtctatgtcgtcgaagggctgcccatcaagggtctgtagcgccgccgtaagaatgtccgcggcatttcggtagttgaccttcaggacttcggcacgtccgccacggatgtcgatgccggcgtcgctgagacgaaagccgccagggtagacggcttgctggccatcaccgatgagcagcaggccgttcggcgcatcaccgacgagctgatgcagcaggctcactccgacgagagtcaaatcctgtacctcgtcagcgatgacggcggcgtaccgcggccgagcggctgggtcacgcaagacggcgatggcctcggtgagcacatcggtgaagtcgtgcactccccgctcggcacgcagacgttcgtactccaggtagagctgccaggcggcctcgcggtgaacgcgtcgcagcgcagtccggcgcccgggccgggtagccgtaaggtactgccccagctcagtgaagcctcgccccttgatgacgtaggtgatctcgtcctgccagtacatcgggttaggttcgagctccgccagaacgctgctcctcccgacatgcagccatgcgcgggagaagcaattgccggtcgccgccagatccactcgtaggtgcactccacgctggtcaagcagcgacctcgcccaaccgtgcaggctgcaaaactcgaccctgtcgacgaccgccggggaaaggcgcgccaggagctgcgcctggacccggggaaggttcttcacgaatgtgacatagaggattttgcctaccgtacgctgggcaagccagacggcccggtgtagacctacgacggtcttgcccgtaccagccgcgccgctgatccgagccggaccgttccaccggcgtctgacgatggcgagctggtcgggatgcagatacgtcatccaactttcgatcgggcgggccagcacggactgttgctccgcgcgagcgatcgcatccacgtcgaagagcgacggtgccttttgcggggggtcactgcggtcgacctgaaccggccgctcaacgatgtcgggtatgtcgtacgcgggaaacttgccagcgaggtgaacggccactcggccgacctgcggtgtggtgaggcggcgcggcagggccgccaaccacggcgcgatctccttgacgccgcggaggaaaaccgtaccgacacgctgttcgacggattggttcgcgaacaccatgacagaagccaccacggccggcgccatgtcgaggactgctagctcgtcgtgcaccctgctcgtgatcgcacggagtttgatgatctcttggtgacgatcgtccgagccggcgtggagccggccgtcgagggccgtcggcgggcttctccagttcttgacgtcaatgacgaagacgccgccaggccccaccagaatcatgtcgacattggctactgcactgccgggccaacgtcggtccaccagtagagtccagccagctccagtcaacacgatcagggcggccgctacttgctgctcccctatggccgccgccgcgtatcgagctgcgaccgcctgggctcgccggtaccgacgcatgagctctgccgcatgctcacgctcacgtaaggcacgaccgatcgcagatcctccagcgggcacaggcgacctccatagaagactttaagtggcgatcatagaacggtgtgtaacgttggtcttcaggtaaaggcggccacgccggacagacgtgtcgatacggaaggctgctccagcctcgagcgcggacaggatgtcgtcgtccagtcggtcgccgacgtacgcgatgtcctccgcaaaggtgaacgaccgatccgctgaccgacccggcgacgccgtcggccttgcaccgcaatcctgccatcgataagttacgatgtgaatcggggtagagcggatggcggacgggcatgtaaggcggcaggaagcagtcgacgtgttccctgccggtgtgtgcgacggcgatcgcggtccgggcggatggggagctgtccttcgatacggaagtcacaaccgtgaggtctacggcgccgaactcgcactgacgtccagcgaccggatgctgttgacggcggtggcggaggccctcgaccgactgacgcgacccgtcgcggtgcgggttcatgccgatcaaaccattgccggccggcatcgcgacctcaggtcgcggctgactgcagccgctcagctacatcaggtccagtgggtcggggaggccgccttttctggcgctggagcagaacgggcgggcgccttggcgggaaccggcctgctcgaggccacgcaacggctcaactcccgctgcgtccatgaccttgtcacccgccaatgctggcagtgccggccgtcggccagcacgcgcccgcaacgcgtcgcggtcacctccggtggcgccgtcttccacctcagcgggggctgcgccgccctcaacgacggctggcgacgtatcgagcgacgcggtggcgtccgatccgacctgacgtgggtaccgactgtcgacgccatcgccgccggacgcggcacatgcgaagtctgctgcgccggtcacgacatctgatgacaccgacagcgcgacggccggaaaggggatttagccgcctccggcgctccaccagcagccgacgacagcgaaccgccggggttgcggttcgcatgcaagatcaacgtaggccgggcgttgcaccatacgatccacgcggcctccgtcaccggcgacccgctgcctggacggttcgccagctcacgcggcagtagaagtccagcgtaagcaggacgcccggctggagatgaggactccaggacaccggcggatccccgacggcgacggggtcgactatggcatcggcgactggatcctcgcattcgtggtcaatgagagcgaaattgtcgtaacgccctccgcgacaggctcatcgccggagggacgctcagcaccgggtcgttcccctatcgcaagctaccggtgacaggagcgaccagccgttcggcgagggcaggcgctcacctggggcaaagcgcggtgtccggctggggctgatcgatccgcgtctgcgtgacgagtccgcacacagatcgaagtgaaggccgccaagaccagaggcacacgagacggttggccggcgaccccaggtcgctccgacgggtgggtggctgagtcacgactggtcgaaccaggggactcataatcccttggccgacggagtgggccaggtgggctcccagaacccgggcaggatttggggccggcggttaccgctgctcgtagagttcaagccggaactgtgacacccgtagcaggcgcccttcgggggcggaccgtgatcgatccgcccaccgcaacccacgtaacgtggggtctgggggtcgcccccaggcgaacaaacgtggggcgggcgggactcgaacccgcgaccgagggattatgagtcccctgctctaacccactgagctaccgccccgtaccggcggcgatcgtaacccgcggcccgctcccgcagctagcgatctatcgctccaccagcgtctgtggcaacaaaacgatttggtatcgggggtcggagaccatgtccggcggctgaaggtcagcgatggcgggcagattgtcttccccgacgcccggggattccgggccgtcctgagtggtgaattcggcgaagttctccgggttgaagtcgctcatgacgtctcctcgtggctagaccccgacctgcacgccgagtgacgccaggacttggccggcggtgcgccagccgccggccatcgcaccttggatggatgggctgtcacggtggtcgccggcgacgaacaggccgtcaccgagggctaccgacttgcggagggtgttctggggcacccgggcggcggggagtgcgttcgggatgctgatcacgttgaggaggtcccagtcgtcggtggaggtgccgtacatgcgggccagttcgacgcggatgacagcctcggaggcgctggagggggcggagacgccgacgacggaggcggcgatcaggctgtggccgccgggggcgtattccggggcggcgttgctgatcacgacggtgttggcgacgatctcccggcgctcgccgtcgaggagcaggatcggttcgtcgatgggtgccagggacgcgccgaagtagaaggtggtcagcccgtgcatgtcgggccggggcagctgcgggagcaggtcggcggcgctgagcgggtcggtggcgacgatcacggcgcggcagcggatttcgccgccttcggtgacgaccagaccggggccgatgctgagggtgcgggcgccgatcagcagttgcgggaagggcaggggaccggcgacggcggcgggcagcgcggccatgccggcggccggcaccccgatccggccgcgggtgaaggagcgcagcaccatcgcggtgacgtggctggacgtgtcgagggaccggtcggcgaagacgccggagaagaacggccgcagcacctcttcgatgatgcggtgggagaggccggctttgcggagcatctcctgggtggtggtctccggcgcttcgagcagcttggcggcgggcgtggtggcgcatcgggtggcgagggcggcgaatttgagccggtcggtgagagagccgacgccggacagcagggtctgcggggtggccagcggttcgcggagcgggttttcgaggcggtgcagggtgccaccacgccggaccaggacgccggcggtgaagtaccgcatttccagggcgtcgatgtcgacgagggcggagagccgggggtacgcggtgttgaggacctgaaatccgcggtccatccgccagccgtcgacgttttcggtggcgacccgcccgccgagccggtcggatccttcgatgagcagccattcgacgccggcgcggtcgagtcggcgggcggcggacagcccggcgagcccgccgccgacgatgacgacgtccacctcgaccggctgcgacataaccacctcactgagagcgaactacgcgagccccagcgtaaccgtgcacttcgggccaaggaggcgaaagtgcaaggcagccgaaaccccaagatcaacaacattgcccgggtacgcgcggggccggcacgccgcgcaccgcgtcgcgccacccccgtccagggtgcgccctccccgcccgcaccgcacgccgggggcggacgtcacgtacgccgtcatggcgtgcagtgccggccgcgaccgcaacccgccgcggacatgcaaaaggcctcctgaaccgcggattccgcggccggaggcctcctgaactgaaagctcccccgattggactcgaaccaataacctgccggttaacagccggctgctctgccaattgagctacaggggatcgtgctcgccgccgggtttccctggcgacggagaagagattacacgaccccgggggcttcgcgcgaaggggatacccccggagcgtttcgcgggccgcgaccaggtgtgactcagggcaacacgagtgaaagcgagatgacgggagtaccggcgcggcaggatgggtatgcacgccggcagacgcgtgcgcgtcacgaacggaaggagccgccatcatgcgcggaaagctgatgttcctcaccggtctcgcggcgggcttcgtcctgggcagccgggccggccgcgagaagtacgaggagatccgggcgaacgcccagaaggtctgggagcacccgacggtccaggaggccgccggtgtggcgcaggcccaggcgaacaagctctacaccgagggcaaggacaagctgcagtcgtccaagctcggtgagaagctcggcgccaccagccagagcagcacgtccggcaccacgagcacggacgagctgctcgccccgtcggactcgctctccggcaccaaggggtcgggcagcacgtactgacgctgctccggatcgccgtggaggccgccctcaccggggcggccttcgccgtttcccgggctcatcgcccggaatcaggacgtggggcagggctcgtgctccggcaccagaccgagggcggtcagttcccccatggtgtacgtcagatccgcggccgccgcgccggatccctccacctcgacatactccgtgcgtgcggtgtccgccgcgagcaggtggcgcaggatcggctgccacgcggcccgcggatcggtgatccggacggtgatcaccgacaggccggcgtcggtgagccgatcgacgccggccgccgggtcgggccactcccgggccgcccgggccaggtccaggcagatgccgagccggtccttgtcgacccgggccagcccggccaccgtctcctccggggtgtcgagcacccagccggggcccggctcgaaaccgacccgcaccgcccgcccgacccgccaggccaggtcggcgagacggccggagagccgccgcaggtgccggctcaccgccatctcgcgggcctcgtcccagccgtcccggtgggccaggccgcaggtgccgaccgcgccgcgcacctcgtcggcgggcagcaggtcgaccaggatccgggccaggtccagggtgtgctgcagccgggcggtctcgctccagtcgggcagcgggggcaggccgccgacctcggcctcgggcccgccgttcaccgtgacgacgtcgagcccgcgggcatcgaggtcggcacgcagccgggtgcgggcgcgcccgtcgtcgacgagggcggcggcaagcgggtagggcaggcgcagcgcgatcccgagccggtggtgcgcgggatcagcatcgccgccgatgacggcatccgtccgggacagatcggcattctcggtcaggccggcagcccgaccggtccagccgacggcagcccggtcggcattgtcggtcacaccggcaacggcgagtcgaggatcggcggtccggccggatcgcaggcgggcggcgaccgcatcgatcatggcgaaggcgtcggccgccgttcgcgcgccggtcaggtcgaccccggcgatgaggtgcacggtccggccggaaggatgtcgaagccgcatcagtttcctccccgaacgagctgacccgtgcaggtgcacgtgcatcggctcgtgctgacgattccagtatggaccatccgcggcaccgccttcgatccaccggttccgagccatccgcactccatggccgcctccatcctggaacgtcctgccctccgatacgagcctgcggcgcgatccggatcatcggcgtaccggccgtgcgactccgtgaccggctcattcatgatcaaaacccgccacagagatagctgtacgcctatcccttacccccggatgaccagcgagtagtaagtcggaggaccctcccggagagcgttttcggacgcgctctctacatcatcatctgcataaatggacatgcaccgctcgactgcgcgtgcgtatgcccggtgcccccggcacctcggcgatgccgcactcagagtgggcgcgctcccactgtccggctctgccggctgactctccggccgcctctcgcgccccgctcccctgatcctgctggcgccaccgccgcccgctgacacagcctgcgctgtccgccggtcaaccggcggcgaagggttagcggagcttccttccggggaacaacccgagcaggtcgtactcgtacgtcacagcggggaggggtgacggcggcgaccggtcgcccggcctgagagggaaccccatgagactccagaatcgcccgcacgggcgccacgatcccgaagacgacaagcagtccggcagcgtggccgccgtgcccgccgcctccggcagccacggacggccggaccccggagacggggaaggctcagccgtccagcggaccgacggttcgggcgccgaccacgcgaccgcggccggatctgcggacgcgtcggacgccggccggaccggggccgagcacgcggccgcttcggatgccggccgcggcgacgacgccggccaggcacggcggcgtggggccgaggacttcgacctggcggcggcgagcacgaccgacgtgggtcgtacgcccgacccgaaagacctgtcggcgccgggtccggatgccggcccggaccgtccgtcgcagctgcacgcccgggggatcttcgccgcggtgcggcggaccttcaagcagttctccgaggacaacgtgtccgactgggcggccgcgctgacctactacggcgtcctgtccatcttcccgggcgcgctggtgatcgtctcgctgctggggttgctcggcgacgccggccagcggaccgtcaccgacgcggtcacccagatcaccccgaactcgcagctgcgcgacctggtcaacacggtgctcgaccaggtgcagggcaccggcaacgccgggctggccgcgatcctcggtctggtcgccgcgttctggtcggcgtccggctacatcgccgcgttcatgcgggcgtcgaacgcgatctacgacgtgccggagggccggccgatctggaagaccctgccgatccgggtcggtgtcaccgcgatcgtcggcaccatgctgatcgcctccgccgccatcgtcgtgttcaccggcgacctggcccgcatcgtcggcgagaagctgcacctcggcggggtcgccgtgaccacctggaacatcgccaaatggccggtgctggtgatcctggtcagcctgatgttcgccatcctctactgggcttcgccgaacgccaagaccggcggtttccgctggatcagcccgggcggcatcttcgccgtcctgctgtgggtggccgcgtccgccggcttcgcgatctacctggcgaacttcgccaactacaacaagacgtacggcaccctgggcggcgtcgtcgccttcctggtctggctctggatctccaacatggcgatcatgctcggcgccgaactggacgccgaactcgaacgcggccgcgccatcgccgccggccaccccgccgacgaggagccgttcctggagttgcgcgacacccgcgccctgaagaagggctccgaacacggcctgagccagggctgacccccgccccaccgccagcccgaccacccggcgcccgccctcgctcccccggcgacggcgggcgccggcacatcagcccaccccgggcccgccccaggcgacgcccgaatccggctccccaccaccaggcgaacccagccacacacgcaggcgaccccgccagccatgccggcaacaccgcacgggcacgcaggcgacacagcgaggcacccgcgcccgccaggccgaccccaccgcacgggcacgcgacaacggccaacggatcccccgggcccgcaccctgctcagccagcacctcccctcagccagagccgcagacgggcaacaccgcagacggggacgccgccgaggctgtgggcccgtggcgcggacccacagaccggcgacgcgagacccgcaaatcgacgacgccggggcggtggactggcggcgcgagacccgcgaaccggcgacaccaagccccgcggaccggccgcacccgggccgcgaagccgcaacgccggcagccgcgaaccggcgacacgggagcagcggaccggcgacgccggaccgctacttgcagaggagggtggacatgcggcgcccggagatgctgaggccgatggtgaggagggtgagcaggtagaggatgtcgacgagtgcgagccacccggccgagccgagcgtgatcccgcggatcaggtcgacggcgcgggacagcggggagatttcgacgagccagcggaggaccggcgggtaggagccggcggggacgaaggtgccggagaacaggaacagggcgaactggccggcggcgatcaggtcgaagtcctgccagctgcggatcagggtggcgacggacatgccgagggcgccgaacgcgaagccgaccaggatcgcggcggggaaggcggccagggcgcgcagcggggtggtcaggtccatcgcgaccatgatgatcaggaaggccagggagtacagggtgccgcgggccatcgcccagatcagctcgccgatggcgatctcgaagggccggatcggggtggcgagaatcccgtcgtacagccgcatgtatttcatcttgccgaagaagttgaaggtggtctcggacagcgcaccgctcatcgccgaggaggccagcatggccggggcgacgaacgccggatagctgaccagccggccgtcgggcagggcgatgtcgccgatcagcgcgccgaccccgacgccgatggagaacaggtagagcagcggctccagcaggccgccggccatcaccacccagtacgccgatttcagcgcgttgacgttgcgctcggtgacccgcaccgaccggccggcgctgccctcgaacgacacgagccgcggcagcagcatcgtcagcatcggaccgtcactcccctcgctgtgctcatcgaccggtcaccggacccacggccgggacaagacgccggacggaccattcacatcaccaaccggctgcggaaacgccagcgggccagaaaccagccggccacgcaccaggtcagcaggtacagggcgtgccacagaccggcccagccggggttgagcccgagggtggcggcgcgggtcaggtcgacgccgtgccacaggggcagtgcgtaggccacccagcgcagcagcggcggcagcgacccgatcgggaagaacaccccggagaacagcgacatcggcagcacggcgaagcggaacaggatggccaggtagctgtcactgcggatgctggccgtgtacgccatcacgggggccgcgatcgcgaagccgatcagtgcggacagcggcagcacggccagcgcggcgaccgtgtgcagcgtgccgaaggcggccgcgatgagcaggaacgcggtgacgctgaggagcacccggaagatcatgaaggcgaggtggccgccgacgatgtcgccgacccgcagcggtgaggcggcctgggcgaaatacaccttcatccaggtcagggcgctcagcaccggccagctggcctcgcccagggcggtctgcacggcggtggaggcgatcagtccgggcacgatccagtcgatgtaggcgaagccgtcgacgccggctttcacgtagccgccgacgcccaggccgaagccgagcatcgtgagcagcggcagcaccagcgtggacagggcgctggagcgccaggtccgccgatagttgaccaggtggtattcgagcacgtaacccgcggcggtcatcgctcagtccaccagggtgcggccggtgagctggaggaacacgtcctccaggctggagcggcggaccagggccgaggccgggctcagcgagcggcggcccacctcggccagtgcctcgtcaccgtcggcgacgtagagcagcacccggtcgggcagcacctcgatccggtcggcgatcccggccagtttgccggcgtaggccccctggtcgtcggtggcgaaccggagctcgaccacctcgcgggtggagtgctgctcgatcagcgcgcggggtgagccctcggcgacgatccggccgccgtccatcaccaccaggcggtcgcagagctgctcggcctcgtccatgtagtgggtggtgaggaccagcgtgacgccctgctgcttgagccggaacagccgctcccagaccaggtgccgggcctgcgggtcgaggccggtggtgggctcgtcgagcaggaccagatcgggctcgttgaccagggcacgggcgatggtgagccggcgtttcatgccgccggagagcggctccaccttgctgccggcccgctcggtgagctggacgaagtcgagcagctcgtcggcgcggcggcgggcggtggcgcgcgggatgccgaagaagcgggcgtaggtggtcagattctcccggacggtgagctcgacgtcgaggttgtcgagctgggggcagacgccgagccgggcgcggatggccgggccgtcgcgccgcgggtccatgccgaggatctccaggatgccgtcggtgggtggcgagacgcagccgatcatccgcatggtggagctcttgccggcgccgttcggcccgaggaagccgaacgcctcaccgcgctgcacgtcgacgtcgatgccgtcgaccgcggtgaagtcaccgaatctcttgatcaatccgcgggcgtggatgagagcagtcacgcccccgaccctacggagggggtgcgacagaattctgcgccgcgcccaccagctcggcggtctcggcgatcaccgattcccggtcgacgggtgtcccggagtcgtagcgcaccgcccagctcagcccgtcccgcccgctgacccggcggccgaccacccggaccgcgccgtgcgacagctcgtggtgggtggtgtaggcgaccgaccgggtgacccgggagcgcacctggtcgggcagctcgcccggcgccaacagcaggacggtgatcaccggaccgtccaccagcacggtgtacccgtcgcgttcctcggccacctcggccggggtgatccgcagctcgcggccggaccaggcggccttgtggatctcgtgccagcccagccggtcggcaccacccggcagccagaggccccggttggtggccacgaccacgccctgctcgccggcggaccaggcgagcacccgctcctcggcctcgagcgggggccgggactcggccggcagcgcgggccggcgtcggaacaacttcacaggtcacctgccgcttgttcgctcagagcgcgtttctgctgttccagggagaagagttcgccggcctgggccagatattgatccttgtgggtgaccgggttgagccgctgcagccgggatttcaggtcgcggatcacctggatcacccggggcagttgcagcttggccagcagcacctggacgtagtgcgggtcgggcgccccgtcgagcagcagcggctcgacggccagctggccggcggcggcctggctgccgatgtcggcgcaggcgtcgcggaccttctcgatccagaccacgccgctgaccgcggagctggtgccgccggccgcggcgatcgcctcgcggaccgcccgcaggaccgggtcgttgtagttctccgggccgaccgcgtcgaacatcgggccggccagcaccggctcctgcagggcgagcttgagcgcgtcgcgttcgacgaggcgttgcggtgcgtgggtggcctgctgcgggaccggttgaacctgttcaccgcggagcgcgtggttgaccgcccgctgcaccggctccaggtccatgccgagatcgccggccagtttccgcgcgtactccggccttttctcccggtccttgatcttggcgaccagcggggcggcgcggcgcatcgcctccacccggccctcgaccgtgtccaggtcgaagcggccgatggtgtgccgcagcgcgaagtcgaccagcggctcccggccggcgatcatgtcgcggaccgccaggtcaccgcgggccagccgcagctcgcacgggtccatgttgtccgggctgaccgcgatgaaggtgcgcccgacgaaacgctggtcctcctcgaaggcgcgcagcgccgccttctgcccggccgcgtccccgtcgaaggtgtagatgatctcgccggtgaagctgtcgctgtccatcagcaggcggcgcagcaccccgatgtggtcgacgccgaacgcggtgccgcaggtggccaccgcggtcggctcgccggcctcgtggcaggccatcacgtcggtgtagccctcgacgatcaccgcccggccgcgcttggcgatctcccgtttggcgtggtcgatcccgtacagcacgtgggatttcttgtagatcggggtctcgggggtgttcaggtatttcgggccgtcgtcgtcgtcgaagagtttccgcgcgccgaagccgatcgtgtcaccggtcaggtcgcggatcggccagagcagccggcggcggaaccggtcgatcagcgagccggaccgggccgtcttggccaggcccgccgtgatcagctcgtcggtggtgaagccgcgcatcagcaggtgtttgctgagcgcgtcccacgagtcgggggcgaagccgcagccgtatcgctccgcggtgtcccggccgaagccgcgctcggcgaggaactcgcgggccttgcgggcgccggccgagccgagctggtcgcggtagaagtcgacggccgaggcgtgcgcggcgatcagccgctgccgctgcccggtctgcggacgggggccggccggcgcggcgccgtcggtgtcgtagcgcagctggatgccggccttgccggccagccgctccaccgactcgatgaacgacaggtgctcggcgtccatcaggaacttgatcgcgtcgccgccctgcccgcacccgaagcagaaatacaccccccgggccggggagacgttgaacgacggcgacttctcgtcgtggaacgggcacaggcccttgagattgccgccgcccgccgagcgcagcgtcacggtctcgccgatcacgtcggcgatcgaggtgcggtcgcggaccagcgcgatgtcctcgtccttcaccctgccggccacggcatacatcctgcctcgcgccgtaccgggattgccagcagggtcgcctcagcgcgtgccggtcaggtcgcggtgccaggccacggccgcgtgatcggtgagcgacgccacctggtcgacgatcacccgcagcgcctcggcgtccgagccggcggccgcgtgcagcgggcggaacagcgggtcgaggcggtccggggcccggccgagcgcctccaccagctcgaccacgatggtgcgctgctgctcgtaccaccgctcggctgagcgcatccgcatcacgtaccggaaggccatgcccttgagcagcgcgcactggttgcgcacagtgcgcgggacgaccaggtcggcgtcgtagcggcgcatcgggtcggtgccgtactggctgtgcgtggcgccgaccgcggaggagacgaaccggccggtgagcacgctggtcatccgtttcagggtgacctgcgcggcgtacgaggagtcgtagccctcgaccgcggccaccgccggatcggccagcaggtgctccagcgactcgccgagctggtcggccgtctcgtcggagtaggtggcggccacgtccgcgcagagttcggcgcgctcggccgggtcgcgcagcagcgggccgaggtcgaggtagccgccgtgcaccccgtcctcgacgtcgtgcaccgagtaggccacgtcgtcggcccagtccatcacctgggcctccaggcagcggcggtcgtcgtcgcggccgtcgcgcagccaggtgaagaccggctcgtcgtcggcgtacacgccgaacttgcgggtgccggggcggcggaaccacgggtatttcgagcaggcgtccagggtggcccgggtcaggttgaggccggcgccgggcaccttggcctccagccgggtgagcacccgcagggtctgcgcgttgccctcgaagccgccgcacgcgctcgcggccacgtccagcgcggcctcgccgttgtggccgaacggcgggtgaccgatgtcgtgggccaggccggcgacgtccaccacgtcgggatcgcagcccagccgcgcgcccatctcccgggagatctgcgcgacctccagggagtgggtcaaccgcgtacgcaggaagtcgtcgaccccggcggtgtgcacctgcgtcttggccgccagccggcggaagccggccgagtgcagcacccgggcccggtcccgttgatacggggtgcgcccgtagccgctgtccttggcgggctcagcggcccagcgctgggcgtcggcagcggtcatgatccccagcctaagccggatgtccaggatgccgatggggatgccgtggagtccgtttcccggcgccgcggcgtcacgatcgtcgcccgtctcgtgatcatgggtgccgccggactgctctcggtcggcctggtgaccgcgttcgcggtgcgcaacgcctccgaccagacggcggcgaacgaggagatcgccacggtcagtgaggcgatgagcgatcagtggaacgccgacatgcagcacgacgcgctgcgggccgacgtgatgtcggcgatgtacgcgacgaccgcgagcatgcgggagacgttcgcggtcgacgaggtggccgaccacggcgccaccatgctgcagatgtacgacgatgccacgaaagccgccccggccgccctcaaggccgactatgtggcgatccggccgtccgtggtggcgtacaccgaggccgcgaagcgcatggtggcgaccgccgagaccgaccaccccgccgcggccgccggcctgtccgacttcctcaaggtctactccgacctcgaggagaagctcggcgatctcgacacccggatgtacgccgaggtcaaggccgccgcggcccgcggcgccgagtcgtcgaggtcgagcaaccggttcatcgtgatcgccgcgctgctggccgccctgatcaccgcgacggcgtgcgtgctgaccgtgcgggcggtccgccggccgctgcgcgggatgctggacgcgctgcgtgcgctggcccgccgggacctgaccgtgcgggccccggtggtcaaccgggacgagctgggtgcgatggcggtggcgctgaacgaggcggccggcgccctgcaggagaccgtgtcggcgaccgccggccgggtgggggtgctgacccaggccagcaccgagctgcagaagctggccggcaccctggaccggtcggcggaggagacctcggcgcaggcgcgcagcgcggacggctcggccggcaacgtctccggctcggtgtcggcgatgatggccgccaccgagcagctgtccgcctcgatccgggagatcgccaagcaggcgctgtccgcggcggccaccacgaacgaggcgaccaccagcgccaaccggaccgcgcacgcggtggcccggctcagcgaggcgagccgggaggtgggcgcgatcgtgcagatgatcacgaacatcgccgagcagaccaacctgctggcgctgaacgccagcatcgaggcggcccgggccgggcacgccggcaagggcttcgcggtggtcgccaccgaggtcaaggacctggcccaggagaccgcgcaggcgaccgcggacatcaccgcgaagatcctggcgatccaggagatgaccaccgggaccgccgaggcgatcgaggcgatcgcctcggtgatcacccggatcgacgacgggcagcggaccatcgcggccgccgtcgagcagcagtcgtcgaccaccgatcagctggcccgcaacgtcggggcggtgtccgcggcggcgtccgagatcagcggcacggtgtcgcacatcagcacgtccagcgcgcacaccgcggagggggcgaacaccacccgccactccgcggagctggtcagcggcgcggccggggagatccgcgccctgatcgacgaattccgctactgaacggccccacggggggcgctcagcacgcagaactcgttgccctccggatcggccaggcagacccacggcacgtcgccctgaccgatgtcgaccggccgggcgcccatgttgaccagacgttccacctcggactcctggtcgtccgggcgcaggtcgagatgcagccggttcttgcccctgcggggctggtcgcagcggaggaagaagagcgccggcaactcgtcggcaccgcgccggatctccaggtaagcgccgtccgcgtgctcgtcgacgatcacatagccgagcgcctcggcccaccagcgccccagccggcccggatccgccgcgtccaccacgacctgctcccagtgactgggcatgtgacctcctgacaatcgacgcgtggcgatcaggttacgcgacgccgcccggccggcgacccgaaccggcgccggggcggccgccggatgcgcaggtcacgggcacgaccgcgagtcactggaccatgacgcacaaaacgtgcgacctgtcggctcactgtcaccggaggatggcccacggtggcgggcacggcgattgatcgacccccatcgcaagacccaactgaacagcagcgctgagggctgaggagagaagtgcccggcgtcgatcactgtctgcaggaggccatgacgattcctggcgcggtcggggccagcatcgtcgactacaccacgggctttccggtcgccacgaccggagccgcacccaacgcggatcacgaggcagcggccgccggcaccgcggaggtcgtccaggccgcgaacagccgatcgctgttcgtctcggcaatcccgcacgacctgctcgaagacctgatcatcacgaccgccgggggctaccacctcctgcggatcgtccagaccgatttcgacagtcggctggtgctctacgtctggctggaccgggtgcgcggcaacctcgccgtcgcgcgccgccagatgcaacgcctgaccgacgaactcgtctccgactgaccggcagccggctgatgaccatcacgaccgacgacatgaccaacgcacacaccagtgaggagtgacggtgtccgccacgaagaccgccgcaccggctgatctgctgtcgcaggtcgccggcgagcggcagaccggcgcgctggtgatgggtggccatcccggcggcgcggtctacgtcttcgagggccgggtcatctacgccgagtcgccggccgcgcccggggtcggcgagctgctcacctcgtccggccggctggccgggcggacctggcagaacgcgctcgacctgggaacctccaccgcccgggtgggccggctgctggtcgagcagggccacctcacccagggcgagctggagctgtgcgtgctcggggcgacctacgacgcggcgtacttcgccctggccgcaccgtccggcccggtcgagtttctgcccgcggccacccactggctgggcccggtggtgcacatcgacgcggccgcggtgctgcgcgaggtgggccggcgggtgaagctgctcgacgacatccatccgagtgcgcggatcgacaccgcgccggtcagcccggtgacccggccaccccgggagcgggtgacgatcaccgcggcccagtgggagctgctgatccacgcggacggccagcgcacccccgcggacctggccctgctcctcggccgcgccgggtacgcgaccatccaggagctgcggcggctcgcggctctgggactcatcgaggttcccctggaggtacgtgcggagagccccgagttcgtccgcctcccccagcatcgggccgaggtggcgccggtggcccgccccgcgccgccaccggcgccgcccccaccggtggtgccggtgatcagcagccagccgccgccggcaccaccgcccggggagggcaacaccggagcgaaccggctgccccggctggcccgccgcaaacccggggcgaagctgccgaaggaactcgccgtcgagaatccgccggtgcaccagggcaccgacgaagtcctgctcaaacgca
